United States Patent 7,842,459 (NUCLEOTIDE AND AMINO ACID SEQUENCES, AND ASSAYS AND METHODS OF USE THEREOF FOR DIAGNOSIS) - sequence listing, part 2

SEQ ID NO: 380 - DNA, 4318 bp, Homo sapiens
cgccagtgtgcgggaggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaattgcttgaacccaggaggcagaggttttagtgagccgagattgtaccattgcactccagtgtgggcaacagagcaagactctgtctcaaaaatttaaaaaaaaaaataaataaatcatggacctaaaatgtgtttatatggatttgtggaaaactcagatcatctgtgtggcctcttgtgacttttacttgtgactagaactagaaccaccatcccgtacctttacttaacggcttcacactgacgagaggttgttccttttcctgttcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 381 - DNA, 4158 bp, Homo sapiens
cagggacagaaggggtggtacagggaagattggctctgcaaaggaggcccatcttcctccgctccccgccttggcggtaactgggatttgcgtggtttggtgggcatctttgatctctcaggcccgtccctcccagtgggaacgggggaaatccacacccaatcctgtgctctctgaaatctcctagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 382 - DNA, 2706 bp, Homo sapiens
cttttcctggtccttcctcttatcccggttaatccacgaaatgtagaagttccatcttatttcaacgattagtgctaatcattaataatttagacctgtctggaggagggaatccataggtttaggtctcctagcatcctggcactagccagcagctgctctgtaggagccttctggaaacagcaggaaggagcggcttccccacgagttccccaagtgctttcgttggcccaagtgctttcgttggcccaagtgacctgtttgagtttgctcttcagtttaccccaggcgggaaggcagcctgtctgcgggttggtggccatgttggcagagaaggggttaatctcttgttgctgtaggagccgaggttgcgagctagattgaaagcaggcgctgcagtgccatcgccagcgccgaaggagtaagacgatcttctccgcaacagtgttgaatccggctgaaattttttttcctccccgcctcctttcttgtttttctttaaccagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcaggtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttggaaaaaaaatcaaaa

SEQ ID NO: 383 - DNA, 953 bp, Homo sapiens
cagggacagaaggggtggtacagggaagattggctctgcaaaggaggcccatcttcctccgctccccgccttggcggtaactgggatttgcgtggtttggtgggcatctttgatctctcaggcccgtccctcccagtgggaacgggggaaatccacacccaatcctgtgctctctgaaatctcctagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaaaaaaagagaaagaaagaaagttagccaggtgtggtgacatgcacctgtagttccagctagtagggaggctgaggccggcggattgcccaggagtttgaggctgcagtgagctacgattgtgccactgtactccagcctgggcaacagagcgaggcatggactgtaaaagcaaaggaaaaagaatgggggaatcggcatcagtagcctactctggtggcattgtagaccttggttgtggtgatgcagcagcaaatg

SEQ ID NO: 384 - DNA, 142 bp, Artificial Sequence
  Synthetic oligonucleotide
gggaaaccaccctttatgactcaacagcagatgtctcctctttcccgagaagggatattagatgccctctttgttctctttgaagaatgcagtcagcctgctctgatgaagattaagcacgtgagcaactttgtccggaagt

SEQ ID NO: 385 - DNA, 148 bp, Artificial Sequence
  Synthetic oligonucleotide
attccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaa

SEQ ID NO: 386 - DNA, 143 bp, Artificial Sequence
  Synthetic oligonucleotide
gtcatggaatatcagcctggaggggacttgctgtcacttttgaatagatatgaggaccagttagatgaaaacctgatacagttttacctagctgagctgattttggctgttcacagcgttcatctgatgggatacgtgcatcg

SEQ ID NO: 387 - DNA, 204 bp, Artificial Sequence
  Synthetic oligonucleotide
gtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccag

SEQ ID NO: 388 - DNA, 154 bp, Artificial Sequence
  Synthetic oligonucleotide
cggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaact

SEQ ID NO: 389 - DNA, 625 bp, Artificial Sequence
  Synthetic oligonucleotide
gtaagtagggctgttttccttaatttgggatgttgggattatgaaacactcaagagagatctgagattgttctggcccaaagaagcttctgtaaattacataaataaaggctttaattatctacaggagtagtaaaggctaatgatgtagctgtctttgagtaataattctgccttaaaattgtttgtgtagaactgggtcatttatcaaactctgtgtttatgtggcctttagaatattatccctcagtaagttagaggcacagattaatggagtttgaaggttgtcacttggtttgacacagtttcttccaaaaaagtggatctaggtatttcattcacatatcaggaaaaagactcagattaggcaacatgcccaggttgttctgctaatggctgagtttaaacaaaaaccataaacacctccctgtgtttattcatttgtttccctcgataatatttgtctttgctcacaagcatgtaaaacctataatgtatatgcacagtagattcattcatacatcactttttataatcagttagtgcaaactgaatgaattcattaaaaacaaagacctggtttattatcaacagaaaccacacaatgctcttttttcttttaccag

SEQ ID NO: 390 - DNA, 273 bp, Artificial Sequence
  Synthetic oligonucleotide
agagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggag

SEQ ID NO: 391 - DNA, 506 bp, Artificial Sequence
  Synthetic oligonucleotide
cttttcctggtccttcctcttatcccggttaatccacgaaatgtagaagttccatcttatttcaacgattagtgctaatcattaataatttagacctgtctggaggagggaatccataggtttaggtctcctagcatcctggcactagccagcagctgctctgtaggagccttctggaaacagcaggaaggagcggcttccccacgagttccccaagtgctttcgttggcccaagtgctttcgttggcccaagtgacctgtttgagtttgctcttcagtttaccccaggcgggaaggcagcctgtctgcgggttggtggccatgttggcagagaaggggttaatctcttgttgctgtaggagccgaggttgcgagctagattgaaagcaggcgctgcagtgccatcgccagcgccgaaggagtaagacgatcttctccgcaacagtgttgaatccggctgaaattttttttcctccccgcctcctttcttgtttttctttaaccag

SEQ ID NO: 392 - DNA, 184 bp, Artificial Sequence
  Synthetic oligonucleotide
ctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctga

SEQ ID NO: 393 - DNA, 908 bp, Artificial Sequence
  Synthetic oligonucleotide
gtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcag

SEQ ID NO: 394 - DNA, 144 bp, Artificial Sequence
  Synthetic oligonucleotide
atggagcaggaaatgacccggttacatcggagagtgtcagaggtggaggctgtgcttagtcagaaggaggtggagctgaaggcctctgagactcagagatccctcctggagcaggaccttgctacctacatcacagaatgcagt

SEQ ID NO: 395 - DNA, 1270 bp, Artificial Sequence
  Synthetic oligonucleotide
gtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcag

SEQ ID NO: 396 - DNA, 376 bp, Artificial Sequence
  Synthetic oligonucleotide
gtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttggaaaaaaaatcaaaa

SEQ ID NO: 397 - DNA, 171 bp, Artificial Sequence
  Synthetic oligonucleotide
gagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaag

SEQ ID NO: 398 - DNA, 141 bp, Artificial Sequence
  Synthetic oligonucleotide
gctgtaaaagccagcacggaggccaccgagctgctgcagaatatccgccaggcaaaggagcgagccgagagggagctggagaagctgcagaaccgagaggattcttctgaaggcatcagaaagaagctggtggaagctgag

SEQ ID NO: 399 - DNA, 126 bp, Artificial Sequence
  Synthetic oligonucleotide
gaacgccgccattctctggagaacaaggtaaagagactagagaccatggagcgtagagaaaacagactgaaggatgacatccagacaaaatcccaacagatccagcagatggctgataaaattctg

SEQ ID NO: 400 - DNA, 131 bp, Artificial Sequence
  Synthetic oligonucleotide
gaaggcccaagaagagatgatttctgaactcaggcaacagaaattttacctggagacacaggctgggaagttggaggcccagaaccgaaaactggaggagcagctggagaagatcagccaccaagaccaca

SEQ ID NO: 401 - DNA, 198 bp, Artificial Sequence
  Synthetic oligonucleotide
gtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacg

SEQ ID NO: 402 - DNA, 198 bp, Artificial Sequence
  Synthetic oligonucleotide
gtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaa

SEQ ID NO: 403 - DNA, 194 bp, Artificial Sequence
  Synthetic oligonucleotide
acgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagaggatgctggacaccgagaaacagagcag

SEQ ID NO: 404 - DNA, 136 bp, Artificial Sequence
  Synthetic oligonucleotide
ggcgagagccgatcagcggatcaccgagtctcgccaggtggtggagctggcagtgaaggagcacaaggctgagattctcgctctgcagcaggctctcaaagagcagaagctgaaggccgagagcctctctgacaag

SEQ ID NO: 405 - DNA, 206 bp, Artificial Sequence
  Synthetic oligonucleotide
cttagaaataatttccatcctcatataataacctatggaagactcaccagtgacagggacttctgtatttagaaaaaagcaacctttacgttctgacctttagaactcaatattctttctccgtgaaggttcgtggacattcataaacgttgtcagcatctaacattcctaagtgtggcattatgccaatctttccaaatgtctag

SEQ ID NO: 406 - DNA, 141 bp, Artificial Sequence
  Synthetic oligonucleotide
caagccaaattacagcagcagatggacctgcagaaaaatcacattttccgtctgactcaaggactgcaagaagctctagatcgggctgatctactgaagacagaaagaagtgacttggagtatcagctggaaaacattcag

SEQ ID NO: 407 - DNA, 165 bp, Artificial Sequence
  Synthetic oligonucleotide
ctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagagg

SEQ ID NO: 408 - DNA, 138 bp, Artificial Sequence
  Synthetic oligonucleotide
aatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcg

SEQ ID NO: 409 - DNA, 181 bp, Artificial Sequence
  Synthetic oligonucleotide
aatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccag

SEQ ID NO: 410 - DNA, 187 bp, Artificial Sequence
  Synthetic oligonucleotide
cagggacagaaggggtggtacagggaagattggctctgcaaaggaggcccatcttcctccgctccccgccttggcggtaactgggatttgcgtggtttggtgggcatctttgatctctcaggcccgtccctcccagtgggaacgggggaaatccacacccaatcctgtgctctctgaaatctcctag

SEQ ID NO: 411 - DNA, 170 bp, Artificial Sequence
  Synthetic oligonucleotide
atgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgct

SEQ ID NO: 412 - DNA, 596 bp, Artificial Sequence
  Synthetic oligonucleotide
gtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaaaaaaagagaaagaaagaaagttagccaggtgtggtgacatgcacctgtagttccagctagtagggaggctgaggccggcggattgcccaggagtttgaggctgcagtgagctacgattgtgccactgtactccagcctgggcaacagagcgaggcatggactgtaaaagcaaaggaaaaagaatgggggaatcggcatcagtagcctactctggtggcattgtagaccttggttgtggtgatgcagcagcaaatg

SEQ ID NO: 413 - DNA, 428 bp, Artificial Sequence
  Synthetic oligonucleotide
gtaaagagatgcagaggcgtgctggctcgctgctaacacggcgcctttgcacttctgctgcagccttatgggggaaggagtctttcatgtgtcttattaaccctgcgcaggtgaaatctccttagcttcagcttatttcttattacagaatagctttccatgtctactaccctcccttatttctgcatcccagccaaattataactcagatgctaattaacagctgccccagagataccaatagcactcgcattttgcatttggagctcagatcaaaatacgggctgagctaagagcatatgtgcgtttctgagcatttccaggaataacttggccttaaccttctcttggtttctctggatggtttggtcataaacagatcagcctcacgatgtcttctgtttttcttttctttcacctatgaaaag

SEQ ID NO: 414 - DNA, 136 bp, Artificial Sequence
  Synthetic oligonucleotide
gtggtgttggtgggcaccgaggaagggctctacgccctgaatgtcttgaaaaactccctaacccatgtcccaggaattggagcagtcttccaaatttatattatcaaggacctggagaagctactcatgatagcag

SEQ ID NO: 415 - DNA, 277 bp, Artificial Sequence
  Synthetic oligonucleotide
gaagaattgcttgaacccaggaggcagaggttttagtgagccgagattgtaccattgcactccagtgtgggcaacagagcaagactctgtctcaaaaatttaaaaaaaaaaataaataaatcatggacctaaaatgtgtttatatggatttgtggaaaactcagatcatctgtgtggcctcttgtgacttttacttgtgactagaactagaaccaccatcccgtacctttacttaacggcttcacactgacgagaggttgttccttttcctgttcag

SEQ ID NO: 416 - DNA, 140 bp, Artificial Sequence
  Synthetic oligonucleotide
gagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaag

SEQ ID NO: 417 - DNA, 129 bp, Artificial Sequence
  Synthetic oligonucleotide
aattcctggataagaatgaccattccttggcacctgctgtgtttgccgcctcttccaacagcttccctgtctcaatcgtgcaggtgaacagcgcagggcagcgagaggagtacttgctgtgtttccacg

SEQ ID NO: 418 - DNA, 180 bp, Artificial Sequence
  Synthetic oligonucleotide
gacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcag

SEQ ID NO: 419 - DNA, 303 bp, Artificial Sequence
  Synthetic oligonucleotide
cagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgcccctggagcgagagaagtcccccggccggatgctcagcacgcggagagagcggtcccccgggaggctgtttgaagacagcagcaggggccggctgcctgcgggagccgtgaggaccccgctgtcccaggtgaacaag

SEQ ID NO: 420 - DNA, 241 bp, Artificial Sequence
  Synthetic oligonucleotide
gtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcac

SEQ ID NO: 421 - DNA, 1689 bp, Artificial Sequence
  Synthetic oligonucleotide
ctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacag

SEQ ID NO: 422 - DNA, 540 bp, Artificial Sequence
  Synthetic oligonucleotide
tatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgt

SEQ ID NO: 423 - DNA, 58 bp, Artificial Sequence
  Synthetic oligonucleotide
cgccagtgtgcgggaggcgcggggcggaacagatcgcagacctgggggttcgcagagc

SEQ ID NO: 424 - DNA, 109 bp, Artificial Sequence
  Synthetic oligonucleotide
cgccagtggggagatgttgaagttcaaatatggagcgcggaatcctttggatgctggtgctgctgaacccattgccagccgggcctccaggctgaatctgttcttccag

SEQ ID NO: 425 - DNA, 28 bp, Artificial Sequence
  Synthetic oligonucleotide
gaagaaggctttattggcccaggagcag

SEQ ID NO: 426 - DNA, 102 bp, Artificial Sequence
  Synthetic oligonucleotide
gtttcattttttgaggaagagcggaacatattatctcgaagcacaagcccgtggatcccccaattacagtatgcctttcaggacaaaaatcacctttatctg

SEQ ID NO: 427 - DNA, 94 bp, Artificial Sequence
  Synthetic oligonucleotide
agacatcaagcctgagaacattctcgttgaccgcacaggacacatcaagctggtggattttggatctgccgcgaaaatgaattcaaacaagatg

SEQ ID NO: 428 - DNA, 14 bp, Artificial Sequence
  Synthetic oligonucleotide
tgatgggattctag

SEQ ID NO: 429 - DNA, 112 bp, Artificial Sequence
  Synthetic oligonucleotide
ttggtgatcttttaaaaatccttttaattcttggatgtgttgttgattgaatgtgttctactgaatgatcagcacggattagagccagtaggaaagcagttatcctgtttga

SEQ ID NO: 430 - DNA, 66 bp, Artificial Sequence
  Synthetic oligonucleotide
gtaggagccgcatatgtccatccgtgcattcccaccgtcagcgcgcaggggtgctgtagatcaccg

SEQ ID NO: 431 - DNA, 106 bp, Artificial Sequence
  Synthetic oligonucleotide
gtctgttgtgtcgggtctggactcccctgccaagactagctccatggaaaagaaacttctcatcaaaagcaaagagctacaagactctcaggacaagtgtcacaag

SEQ ID NO: 432 - DNA, 28 bp, Artificial Sequence
  Synthetic oligonucleotide
agcttaaagcgaagtttggagcaagcac

SEQ ID NO: 433 - DNA, 92 bp, Artificial Sequence
  Synthetic oligonucleotide
ggatggaggtgtcccaggaggatgacaaagcactgcagcttctccatgatatcagagagcagagccggaagctccaagaaatcaaagagcag

SEQ ID NO: 434 - DNA, 56 bp, Artificial Sequence
  Synthetic oligonucleotide
ccatgcttggtaatttgcatatcggccctggctgctttcaggctacagagtcagag

SEQ ID NO: 435 - DNA, 51 bp, Artificial Sequence
  Synthetic oligonucleotide
gctaaggatcaagggaagcctgaagtgggagaatatgcgaaactggagaag

SEQ ID NO: 436 - DNA, 54 bp, Artificial Sequence
  Synthetic oligonucleotide
atcaatgctgagcagcagctcaaaattcaggagctccaagagaaactggagaag

SEQ ID NO: 437 - DNA, 96 bp, Artificial Sequence
  Synthetic oligonucleotide
gagctcgaagagaaacatcgggaggcccaagtctcagcccagcacctagaagtgcacctgaaacagaaagagcagcactatgaggaaaagattaaa

SEQ ID NO: 438 - DNA, 117 bp, Artificial Sequence
  Synthetic oligonucleotide
gtgttggacaatcagataaagaaagacctggctgacaaggagacactggagaacatgatgcagagacacgaggaggaggcccatgagaagggcaaaattctcagcgaacagaaggcg

SEQ ID NO: 439 - DNA, 110 bp, Artificial Sequence
  Synthetic oligonucleotide
atgatcaatgctatggattccaagatcagatccctggaacagaggattgtggaactgtctgaagccaataaacttgcagcaaatagcagtctttttacccaaaggaacat

SEQ ID NO: 440 - DNA, 44 bp, Artificial Sequence
  Synthetic oligonucleotide
gtgacaagaatcggctgctggaactggagacaagattgcgggag

SEQ ID NO: 441 - DNA, 54 bp, Artificial Sequence
  Synthetic oligonucleotide
gcacatagagatgaaatccagcgcaaatttgatgctcttcgtaacagctgtact

SEQ ID NO: 442 - DNA, 20 bp, Artificial Sequence
  Synthetic oligonucleotide
gtaaggagggttaacaaggt

SEQ ID NO: 443 - DNA, 105 bp, Artificial Sequence
  Synthetic oligonucleotide
ctcaatgacctggagaagaagcatgctatgcttgaaatgaatgcccgaagcttacagcagaagctggagactgaacgagagctcaaacagaggcttctggaagag

SEQ ID NO: 444 - DNA, 108 bp, Artificial Sequence
  Synthetic oligonucleotide
gttctctattctcatgaaaaggtgaaaatggaaggcactatttctcaacaaaccaaactcattgattttctgcaagccaaaatggaccaacctgctaaaaagaaaaag

SEQ ID NO: 445 - DNA, 44 bp, Artificial Sequence
  Synthetic oligonucleotide
gccagtttccaggagttaggagatatctctgtttccattgctag

SEQ ID NO: 446 - DNA, 45 bp, Artificial Sequence
  Synthetic oligonucleotide
ggtttatttagtcgacggaaagaggaccctgctttacccacacag

SEQ ID NO: 447 - DNA, 118 bp, Artificial Sequence
  Synthetic oligonucleotide
gttcctctgcagtacaatgagctgaagctggccctggagaaggagaaagctcgctgtgcagagctagaggaagcccttcagaagacccgcatcgagctccggtccgcccgggaggaag

SEQ ID NO: 448 - DNA, 92 bp, Artificial Sequence
  Synthetic oligonucleotide
gaataacaaacgaggacagcaaggctgggacaggaagtacattgtcctggagggatcaaaagtcctcatttatgacaatgaagccagagaag

SEQ ID NO: 449 - DNA, 90 bp, Artificial Sequence
  Synthetic oligonucleotide
gtctcccccctgaagaacccgcagggcgctgccctgaagattccacctgctaatacaccttccgagaacttctgcctcagtcaactaacc

SEQ ID NO: 450 - DNA, 105 bp, Artificial Sequence
  Synthetic oligonucleotide
ctggacagaggccggtggaagaatttgagctgtgccttcccgacggggatgtatctattcatggtgccgttggtgcttccgaactcgcaaatacagccaaagcag

SEQ ID NO: 451 - DNA, 45 bp, Artificial Sequence
  Synthetic oligonucleotide
gcccgcgactgtgtttcttacgagcttctgcctgcctgggttcag

SEQ ID NO: 452 - DNA, 81 bp, Artificial Sequence
  Synthetic oligonucleotide
aaactgcttggaaactccctgctgaaactggaaggtgatgaccgtctagacatgaactgcacgctgcccttcagtgaccag

SEQ ID NO: 453 - DNA, 93 bp, Artificial Sequence
  Synthetic oligonucleotide
attgagaacgggctctgcatctgtgcagccatgcccagcaaagtcgtcattctccgctacaacgaaaacctcagcaaatactgcatccggaaa

SEQ ID NO: 454 - DNA, 109 bp, Artificial Sequence
  Synthetic oligonucleotide
gagatagagacctcagagccctgcagctgtatccacttcaccaattacagtatcctcattggaaccaataaattctacgaaatcgacatgaagcagtacacgctcgagg

SEQ ID NO: 455 - DNA, 81 bp, Artificial Sequence
  Synthetic oligonucleotide
aatttggagtgttcgtggattcttacggaagacgtagccgcacagacgatctcaagtggagtcgcttacctttggcctttg

SEQ ID NO: 456 - DNA, 42 bp, Artificial Sequence
  Synthetic oligonucleotide
gtacgtgaggctcagtgtgggggcttctcttttgccagcagc

SEQ ID NO: 457 - DNA, 79 bp, Artificial Sequence
  Synthetic oligonucleotide
cctacagagaaccctatctgtttgtgacccacttcaactcactcgaagtaattgagatccaggcacgctcctcagcagg

SEQ ID NO: 458 - DNA, 28 bp, Artificial Sequence
  Synthetic oligonucleotide
gtaagcattgtcctcccatgcgtggaaa

SEQ ID NO: 459 - DNA, 27 bp, Artificial Sequence
  Synthetic oligonucleotide
ctccctacgttcctcttgtgtcgccag

SEQ ID NO: 460 - DNA, 2634 bp, Homo sapiens
agcctcctggagggccggaaactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcgggtaaggggtgatgtaggaaacaggctctttggatgaattttctcccttaggttctgagggtggtgcctatgtgcccccgagtctgcgtctaacatgtgtttacccatgcctgccttgtgccatggtctgagtgggcgctgggctctgcatggagggctcagagttggagatgggggcccagacctgtaactagtcataatgcagcatgttggatgctaagacagaagtctgggcagcatgctggggcggtgtttcacccccagggtatgctgagcagagcttcacagagcctgaagctctcaggagtccgtctggcagagggtgggtggaagacaggacagagcacagaggtgtgcagagcctagatggtcagggctgagcaggctctaagagcagtctcttgccctggttgtcctgtcagaaaggcttcttgtggatgtgtgtggggatggtggttgagggggaggaggctggagaggccaggagagggccagctctccacctgtccctgcttcctgcctgtcctctggcagtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 461 - DNA, 173 bp, Artificial Sequence
  Synthetic oligonucleotide
agcctcctggagggccggaaactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcag

SEQ ID NO: 462 - DNA, 160 bp, Artificial Sequence
  Synthetic oligonucleotide
ctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcag

SEQ ID NO: 463 - DNA, 128 bp, Artificial Sequence
  Synthetic oligonucleotide
gctgtgtgtggttacggatcacaggaggcactgcccatgcgccccgccagggagggtgaactctactttcctgaggatcgagaggtgaacctggtggagctggccctggctaccaacatccccaaagg

SEQ ID NO: 464 - DNA, 533 bp, Artificial Sequence
  Synthetic oligonucleotide
gtaaggggtgatgtaggaaacaggctctttggatgaattttctcccttaggttctgagggtggtgcctatgtgcccccgagtctgcgtctaacatgtgtttacccatgcctgccttgtgccatggtctgagtgggcgctgggctctgcatggagggctcagagttggagatgggggcccagacctgtaactagtcataatgcagcatgttggatgctaagacagaagtctgggcagcatgctggggcggtgtttcacccccagggtatgctgagcagagcttcacagagcctgaagctctcaggagtccgtctggcagagggtgggtggaagacaggacagagcacagaggtgtgcagagcctagatggtcagggctgagcaggctctaagagcagtctcttgccctggttgtcctgtcagaaaggcttcttgtggatgtgtgtggggatggtggttgagggggaggaggctggagaggccaggagagggccagctctccacctgtccctgcttcctgcctgtcctctggcag

SEQ ID NO: 465 - DNA, 138 bp, Artificial Sequence
  Synthetic oligonucleotide
gtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggag

SEQ ID NO: 466 - DNA, 129 bp, Artificial Sequence
  Synthetic oligonucleotide
gcagtagaacgagtcctgtacccacacctgtccacctactggacaaacttgcaggctgtgctggatgattattcagtatctaatgcccaggtcaaagcagatggacacaaagtctatggagccattctg

SEQ ID NO: 467 - DNA, 158 bp, Artificial Sequence
  Synthetic oligonucleotide
gtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgg

SEQ ID NO: 468 - DNA, 668 bp, Artificial Sequence
  Synthetic oligonucleotide
gtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 469 - DNA, 5 bp, Artificial Sequence
  Synthetic oligonucleotide
aatag

SEQ ID NO: 470 - DNA, 46 bp, Artificial Sequence
  Synthetic oligonucleotide
ctctcagttcatgaagcacaccaaacgccggaagctgacggttgag

SEQ ID NO: 471 - DNA, 26 bp, Artificial Sequence
  Synthetic oligonucleotide
gacttcaacagggccctcagatggag

SEQ ID NO: 472 - DNA, 10 bp, Artificial Sequence
  Synthetic oligonucleotide
cagcgtggag

SEQ ID NO: 473 - DNA, 23 bp, Artificial Sequence
  Synthetic oligonucleotide
ctgtgctgagacagctgtcagag

SEQ ID NO: 474 - DNA, 51 bp, Artificial Sequence
  Synthetic oligonucleotide
ttcatgtctcctacctggatggcaaagggaacctggcacctcaaggatcgg

SEQ ID NO: 475 - DNA, 27 bp, Artificial Sequence
  Synthetic oligonucleotide
tgcccagtgctgtgtcttcactgacag

SEQ ID NO: 476 - DNA, 68 bp, Artificial Sequence
  Synthetic oligonucleotide
atgaccttctcaagtactatcaccaggtgactcgtgctgtgctaggggatgatccgcaactgatgaag

SEQ ID NO: 477 - DNA, 75 bp, Artificial Sequence
  Synthetic oligonucleotide
gttgcactccaggacttgcagacgaactccaagattggggcactcctgccttactttgtttatgtggtcagtggg

SEQ ID NO: 478 - DNA, 7 bp, Artificial Sequence
  Synthetic oligonucleotide
ccactgg

SEQ ID NO: 479 - DNA, 76 bp, Artificial Sequence
  Synthetic oligonucleotide
ctgcctccatcaaccccctgaatgaccactggactctgcgggatggggctgccctcctgctcagccacatcttctg

SEQ ID NO: 480 - DNA, 49 bp, Artificial Sequence
  Synthetic oligonucleotide
gactcatggggaccttgtaagtggcctctatcagcatatcctgctatcc

SEQ ID NO: 481 - DNA, 35 bp, Artificial Sequence
  Synthetic oligonucleotide
ctgcagaagatcctggcagatcctgtgcggccgct

SEQ ID NO: 482 - DNA, 49 bp, Artificial Sequence
  Synthetic oligonucleotide
ctgctgccactatggagccgtggtggggctgcatgctcttggctggaag

SEQ ID NO: 483 - DNA, 4517 bp, Homo sapiens
ggacagggaagcctggggattggttgagcagcgtggggcagaaggaagcccagctcttcctccagcatggcaggggacaataaggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgagagcttcctcccgctgtgtaatggtggtccaaagcattcagcttaccccaaaacacagagtccacccccggcctaagacacacagagaatccactgacatcgctctcggtgggaattcccttctacacatgcctttgggaaccagcgtccccattcagtctccactcctccttccagctatgcttgacaaccatcctgggcatgatctagttggtgcgtctgttcccaaagggccttcacatccatcatgcattgagttgtcacaagcacaggtgagacaggccacatggcttgtgtccattttgctgaatagggaatcagggtccaaggagtttgtcttgattcagtgagtcagggcatgagccatgctcgacaggaatgagcatgccaatctgcagaagaaaaatggcatcatgtaatacatgcccaaagacaggaggggcagggcttcgaaccggctgctgtttcggatcccctatgccatctcccctcctgttcccacaggtcggtgatggctggcttggctctcagagctcagggctggcagcaggaccctcttttcaagggcaccttggcctattgctgcattcaaatcatgctgtccacattcacttggaagcatgtattgggcacctgctgtatgctgggagaaataacaggaataagactcactctccatccagcaggcactcaggggctagtggggctggaggtgaagaacagacaagtaaacagaaccttctagcacagcggcttcttaccagtgcgagccccctgctcctgtgtttgagaaacaatgggcatgtcctctctgcccaagagctcttgtcagaattgtttaaaaaaagaaaagatagaggtggtcagagggaagaacaattgacagcttctctaatctgattttgattgttgctctgtttaaaaaataatactagcctaaatcctcacgccttgactcaggtttctgcaaatgcaagtaggaaattcacatgtgtcagtggaagttcaaacacattgcaccgactcatggagagttattatgttttgttacacagttactgaggccagttttcgccctgacacatgtacttagtgataagagagaggctgtgtgagccgaggttgctctgggagggcagtggacagtgtctgaccccacagcaagccccacacagttttgtgtcatttggttgctgtttctccctttgcagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 484 - DNA, 1687 bp, Homo sapiens
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggtgagagaagaggatacatggggtctttttgtcccagccttgggcccttccccaggcagccccatctcagccaacattcagccagtgcatagaacataacagacaacccggcactccctcttatgggcaggctccaagacacagggactcaggccttcctaacttccctggaactggataaggcccaggaccctaccaccccc

SEQ ID NO: 485 - DNA, 932 bp, Homo sapiens
ttccattttcctaataccagacacaaacaagagagatggcaaggatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgtgagccttgggatgcagctgcggagggaccgttgccacatggagccattgccagttataaagttactgggcagagtgaaggaggagaagaactgagtgcaaatgagacctcatttcagcctcagccagggccaggcggaattggctaaatggtttctctttccttccgttttcatcttttcctctcttcattcctttcctccctttcctcttctccttccttccttctaccacaacttccaatctccaccccgtcgtctcctctctgccctcccctctcctgcctgttctctct

SEQ ID NO: 486 - DNA, 336 bp, Artificial Sequence
  Synthetic oligonucleotide
gacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgag

SEQ ID NO: 487 - DNA, 395 bp, Artificial Sequence
  Synthetic oligonucleotide
atctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaa

SEQ ID NO: 488 - DNA, 145 bp, Artificial Sequence
  Synthetic oligonucleotide
gatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacag

SEQ ID NO: 489 - DNA, 208 bp, Artificial Sequence
  Synthetic oligonucleotide
gtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactg

SEQ ID NO: 490 - DNA, 178 bp, Artificial Sequence
  Synthetic oligonucleotide
ggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgag

SEQ ID NO: 491 - DNA, 203 bp, Artificial Sequence
  Synthetic oligonucleotide
gtgagagaagaggatacatggggtctttttgtcccagccttgggcccttccccaggcagccccatctcagccaacattcagccagtgcatagaacataacagacaacccggcactccctcttatgggcaggctccaagacacagggactcaggccttcctaacttccctggaactggataaggcccaggaccctaccaccccc

SEQ ID NO: 492 - DNA, 358 bp, Artificial Sequence
  Synthetic oligonucleotide
aaagagactgggcatgcgggagcttctggctcttgttccgcaaagggccactagtagcagggtgtgagccttgggatgcagctgcggagggaccgttgccacatggagccattgccagttataaagttactgggcagagtgaaggaggagaagaactgagtgcaaatgagacctcatttcagcctcagccagggccaggcggaattggctaaatggtttctctttccttccgttttcatcttttcctctcttcattcctttcctccctttcctcttctccttccttccttctaccacaacttccaatctccaccccgtcgtctcctctctgccctcccctctcctgcctgttctctct

SEQ ID NO: 493 - DNA, 1485 bp, Artificial Sequence
  Synthetic oligonucleotide
ggacagggaagcctggggattggttgagcagcgtggggcagaaggaagcccagctcttcctccagcatggcaggggacaataaggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgagagcttcctcccgctgtgtaatggtggtccaaagcattcagcttaccccaaaacacagagtccacccccggcctaagacacacagagaatccactgacatcgctctcggtgggaattcccttctacacatgcctttgggaaccagcgtccccattcagtctccactcctccttccagctatgcttgacaaccatcctgggcatgatctagttggtgcgtctgttcccaaagggccttcacatccatcatgcattgagttgtcacaagcacaggtgagacaggccacatggcttgtgtccattttgctgaatagggaatcagggtccaaggagtttgtcttgattcagtgagtcagggcatgagccatgctcgacaggaatgagcatgccaatctgcagaagaaaaatggcatcatgtaatacatgcccaaagacaggaggggcagggcttcgaaccggctgctgtttcggatcccctatgccatctcccctcctgttcccacaggtcggtgatggctggcttggctctcagagctcagggctggcagcaggaccctcttttcaagggcaccttggcctattgctgcattcaaatcatgctgtccacattcacttggaagcatgtattgggcacctgctgtatgctgggagaaataacaggaataagactcactctccatccagcaggcactcaggggctagtggggctggaggtgaagaacagacaagtaaacagaaccttctagcacagcggcttcttaccagtgcgagccccctgctcctgtgtttgagaaacaatgggcatgtcctctctgcccaagagctcttgtcagaattgtttaaaaaaagaaaagatagaggtggtcagagggaagaacaattgacagcttctctaatctgattttgattgttgctctgtttaaaaaataatactagcctaaatcctcacgccttgactcaggtttctgcaaatgcaagtaggaaattcacatgtgtcagtggaagttcaaacacattgcaccgactcatggagagttattatgttttgttacacagttactgaggccagttttcgccctgacacatgtacttagtgataagagagaggctgtgtgagccgaggttgctctgggagggcagtggacagtgtctgaccccacagcaagccccacacagttttgtgtcatttggttgctgtttctccctttgcag

SEQ ID NO: 494 - DNA, 172 bp, Artificial Sequence
  Synthetic oligonucleotide
gaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggg

SEQ ID NO: 495 - DNA, 2460 bp, Artificial Sequence
  Synthetic oligonucleotide
gggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagag

SEQ ID NO: 496 - DNA, 218 bp, Artificial Sequence
  Synthetic oligonucleotide
gaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 497 - DNA, 118 bp, Artificial Sequence
  Synthetic oligonucleotide
ggggtggtgcagggcaggggtggtatatcctgtctgacggagggcgggcctcgccagtgccagagagggacgaaccagggtggaagcgccaggagcagctgcagggagccctcacgcg

SEQ ID NO: 498 - DNA, 104 bp, Artificial Sequence
  Synthetic oligonucleotide
gttccatgtatgatggcttggctgacaattacaactatgggaccaccagcaggagcagctactactccaagttccaggcagggaatggctcatggggatatccg

SEQ ID NO: 499 - DNA, 43 bp, Artificial Sequence
  Synthetic oligonucleotide
ttccattttcctaataccagacacaaacaagagagatggcaag

SEQ ID NO: 500 - DNA, 107 bp, Artificial Sequence
  Synthetic oligonucleotide
caaggtttcgataggaacatgctgggaaccttagctggggccaacagcctcaggaacttcacctcccgattctaagaagagactgtccaagcaagttaggcttgcag

SEQ ID NO: 501 - DNA, 22 bp, Artificial Sequence
  Synthetic oligonucleotide
gttagggaggttggggcggggg

SEQ ID NO: 502 - DNA, 53 bp, Artificial Sequence
  Synthetic oligonucleotide
gcagtgttgctgtctgcgtgtccaccttggaatctggctgaactggctgggag

SEQ ID NO: 503 - DNA, 1911 bp, Homo sapiens
ccaggactgggcggcgccgacgcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatcatttttat

SEQ ID NO: 504 - DNA, 4625 bp, Homo sapiens
cccccggctttcatatcagactaaagattcaaaccttgagctgaggaagtgtttatttctttagtttttctttccctgtctgccccttctcctaccttaggaattccttcatatataggctggattggtctctgtgtctttttcgtcttcatacgcctcttcaccatcttaagccatttccttaatcttcggagaacatgatgggattgttttctgattcaccagtttggttgtctgtggtttccaacttgctgaattctctgatttacagaggtgcattttttatctccaagcaatcttttgaattcccttttcaagtcagcctccctgcctccctgagttttctttttgagacagtcttgctctgtccccaaggttgaatacagtggtgtgatcatggcccactgcaacttctacctcccaggatcaagtgatcctcccacctcagccttctaactagctgagaacacaggtgtgcaccaccatgcttggctaatttttttgtttttttgagagacagggtctcactgtgttgcccaggctagtcttgaactctgggactcaagcaatccttccgcctcagcctcctaaagtgctggcattacaggggtgagccacaaggccggcctctccctgagttttctaatgtgtgtatatacactcttttttttcttttttccgagacaaggtctctcttagtcacccgggttggagtgcagtggtgcaatcatggctcactgcagccttgaattctgggctcaagtggtcctcctaccatagcctctggagtagttgggactacaagcaccaccatggctggctgatttttttatttttagtagtgatggagtctgtgttacccagactgttctttaactcctggcctcaagtgatcctctcctgtcagcctaacactaatcccagagtgttaggattacaggcgtgaaccactgcctttggccatgtgtgtgctcttagtccttgttgatgccacgaattagagaggttctggaattttctcatgttcctcagaaactccatgtcccatggagatgcttgagtggctcagattcacctctgtgaattgtggtttgaactgtaagatgtgtacatttgacttgtgcttatctgtcttcactcttccttacagagggggatctctgtgtgtcccagatgggggataacaagggtttgggaagagactgtggatccctgcctaatctctaggtcctgaggaaggaagaaaagaatggtctgcatttgttctagttttttatctccccatggagtggctggccagctgcgggaagtggaggcggcgaggccccaggctgctgtttctaggagttggcctcatcacccaggtccctggctacctggggtgtttctctcatcctctgagtgccctggttatgccatgagagtcagccatggtggtatctccaggtgactaaggtcacatagcagcacacaagggttcgtgtttgtggaacctggtagcttccttcagagctgacatttgcccacagccagcctggcccagccccataccaccagccctggcgctctggggcgtgaggtgccttttctgcccccctgctctagggcaggtggaaatcacccatggtgggtctacatctgatagaagcatcttatagttctgcttctggaccagaccatcctgggtttttctctgttctgctgaagggttccctccacgtgtccatcacctcggtgaactcttgggagacctgggaagatgctggcctcacctctcgcccctcctttccctcattgtgctgccaccatccttctcacacaggctctccagggagagctgggcaggatgggatcttcctgggttcccaccttgctccgtgccccctctcactgttcctgaagtgtggccacggactgccttgttttctggaaagtcccaagtctggaccatgactgagcagcattctcggctatctgccacctgtctggggctcctggcccctcttagactcccctctcccttctgtttcccccgagcccctgacttggacctgcagggtggggagagggatgggacgagaacctgtgctggggccaaaggtcgcactgggggaaggtggagccagggcagcagagtgcctggcgtcggcccctatcctgtcactagttcccccgttctggcccctggcaggtttgtaaccccagatcagaagtactccatggacaacactccccacacgccaaccccgttcaagaacgccctggagaagtacggacccctgaagcccctggtacgtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctggact

SEQ ID NO: 505 - DNA, 1645 bp, Homo sapiens
aagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgctattttaggtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaacccccttctatctgccaacccctagctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctggact

SEQ ID NO: 506 - DNA, 256 bp, Artificial Sequence
  Synthetic oligonucleotide
ccaggactgggcggcgccgacgcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctg

SEQ ID NO: 507 - DNA, 221 bp, Artificial Sequence
  Synthetic oligonucleotide
gtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggag

SEQ ID NO: 508 - DNA, 163 bp, Artificial Sequence
  Synthetic oligonucleotide
gacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccag

SEQ ID NO: 509 - DNA, 179 bp, Artificial Sequence
  Synthetic oligonucleotide
gtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcg

SEQ ID NO: 510 - DNA, 288 bp, Artificial Sequence
  Synthetic oligonucleotide
gaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcag

SEQ ID NO: 511 - DNA, 126 bp, Artificial Sequence
  Synthetic oligonucleotide
aggaagaggcgtgtggctctgtcccctgtcactgagaatagcaccagtctgtccttcctggattcctgtaacagcctcacgcccaagagcacacctgttaagaccctgcccttctcgccctcccag

SEQ ID NO: 512 - DNA, 140 bp, Artificial Sequence
  Synthetic oligonucleotide
tttctgaacttctggaacaaacaggacacattggagctggagagcccctcgctgacatccaccccagtgtgcagccagaaggtggtggtcaccacaccactgcaccgggacaagacacccctgcaccagaaacatgctgc

SEQ ID NO: 513 - DNA, 170 bp, Artificial Sequence
  Synthetic oligonucleotide
gtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatcatttttat

SEQ ID NO: 514 - DNA, 2191 bp, Artificial Sequence
  Synthetic oligonucleotide
cccccggctttcatatcagactaaagattcaaaccttgagctgaggaagtgtttatttctttagtttttctttccctgtctgccccttctcctaccttaggaattccttcatatataggctggattggtctctgtgtctttttcgtcttcatacgcctcttcaccatcttaagccatttccttaatcttcggagaacatgatgggattgttttctgattcaccagtttggttgtctgtggtttccaacttgctgaattctctgatttacagaggtgcattttttatctccaagcaatcttttgaattcccttttcaagtcagcctccctgcctccctgagttttctttttgagacagtcttgctctgtccccaaggttgaatacagtggtgtgatcatggcccactgcaacttctacctcccaggatcaagtgatcctcccacctcagccttctaactagctgagaacacaggtgtgcaccaccatgcttggctaatttttttgtttttttgagagacagggtctcactgtgttgcccaggctagtcttgaactctgggactcaagcaatccttccgcctcagcctcctaaagtgctggcattacaggggtgagccacaaggccggcctctccctgagttttctaatgtgtgtatatacactcttttttttcttttttccgagacaaggtctctcttagtcacccgggttggagtgcagtggtgcaatcatggctcactgcagccttgaattctgggctcaagtggtcctcctaccatagcctctggagtagttgggactacaagcaccaccatggctggctgatttttttatttttagtagtgatggagtctgtgttacccagactgttctttaactcctggcctcaagtgatcctctcctgtcagcctaacactaatcccagagtgttaggattacaggcgtgaaccactgcctttggccatgtgtgtgctcttagtccttgttgatgccacgaattagagaggttctggaattttctcatgttcctcagaaactccatgtcccatggagatgcttgagtggctcagattcacctctgtgaattgtggtttgaactgtaagatgtgtacatttgacttgtgcttatctgtcttcactcttccttacagagggggatctctgtgtgtcccagatgggggataacaagggtttgggaagagactgtggatccctgcctaatctctaggtcctgaggaaggaagaaaagaatggtctgcatttgttctagttttttatctccccatggagtggctggccagctgcgggaagtggaggcggcgaggccccaggctgctgtttctaggagttggcctcatcacccaggtccctggctacctggggtgtttctctcatcctctgagtgccctggttatgccatgagagtcagccatggtggtatctccaggtgactaaggtcacatagcagcacacaagggttcgtgtttgtggaacctggtagcttccttcagagctgacatttgcccacagccagcctggcccagccccataccaccagccctggcgctctggggcgtgaggtgccttttctgcccccctgctctagggcaggtggaaatcacccatggtgggtctacatctgatagaagcatcttatagttctgcttctggaccagaccatcctgggtttttctctgttctgctgaagggttccctccacgtgtccatcacctcggtgaactcttgggagacctgggaagatgctggcctcacctctcgcccctcctttccctcattgtgctgccaccatccttctcacacaggctctccagggagagctgggcaggatgggatcttcctgggttcccaccttgctccgtgccccctctcactgttcctgaagtgtggccacggactgccttgttttctggaaagtcccaagtctggaccatgactgagcagcattctcggctatctgccacctgtctggggctcctggcccctcttagactcccctctcccttctgtttcccccgagcccctgacttggacctgcagggtggggagagggatgggacgagaacctgtgctggggccaaaggtcgcactgggggaaggtggagccagggcagcagagtgcctggcgtcggcccctatcctgtcactagttcccccgttctggcccctggcag

SEQ ID NO: 515 - DNA, 1362 bp, Artificial Sequence
  Synthetic oligonucleotide
gtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtc

SEQ ID NO: 516 - DNA, 850 bp, Artificial Sequence
  Synthetic oligonucleotide
aagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgctattttaggtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaacccccttctatctgccaacccctag

SEQ ID NO: 517 - DNA, 121 bp, Artificial Sequence
  Synthetic oligonucleotide
cctcaccctgtcaggtatcaaagaagacaacagcttgctcaaccagggcttcttgcaggccaagcccgagaaggcagcagtggcccagaagccccgaagccacttcacgacacctgcccct

SEQ ID NO: 518 - DNA, 186 bp, Artificial Sequence
  Synthetic oligonucleotide
ggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcag

SEQ ID NO: 519 - DNA, 141 bp, Artificial Sequence
  Synthetic oligonucleotide
ccagactctcaggtggaggcaacagggccatgtgctgccctgttgccgagcccagctgtgggcggctcctggtgctaacaacaaagttccacttccaggtctgcctggttccctccccaaggccacagggagctccgtcag

SEQ ID NO: 520 - DNA, 94 bp, Artificial Sequence
  Synthetic oligonucleotide
cgaggatctggatgagctgcactaccaggacacagattcagatgtgccggagcagagggatagcaagtgcaaggtcaaatggacccatgaggag

SEQ ID NO: 521 - DNA, 72 bp, Artificial Sequence
  Synthetic oligonucleotide
gacgagcagctgagggccctggtgaggcagtttggacagcaggactggaagttcctggccagccacttccct

SEQ ID NO: 522 - DNA, 79 bp, Artificial Sequence
  Synthetic oligonucleotide
aaccgcactgaccagcaatgccagtacaggtggctgagagttttgaatccagaccttgtcaaggggccatggaccaaag

SEQ ID NO: 523 - DNA, 14 bp, Artificial Sequence
  Synthetic oligonucleotide
aggaagaccaaaaa

SEQ ID NO: 524 - DNA, 109 bp, Artificial Sequence
  Synthetic oligonucleotide
ggaagtcttctgaccaactggccctccgtccctcctaccataaaggaggaggaaaacagtgaggaggaacttgcagcagccaccacatcgaaggaacaggagcccatcg

SEQ ID NO: 525 - DNA, 24 bp, Artificial Sequence
  Synthetic oligonucleotide
gtttgtaaccccagatcagaagta

SEQ ID NO: 526 - DNA, 18 bp, Artificial Sequence
  Synthetic oligonucleotide
ctccatggacaacactcc

SEQ ID NO: 527 - DNA, 58 bp, Artificial Sequence
  Synthetic oligonucleotide
ccacacgccaaccccgttcaagaacgccctggagaagtacggacccctgaagcccctg

SEQ ID NO: 528 - DNA, 4 bp, Artificial Sequence
  Synthetic oligonucleotide
gtac

SEQ ID NO: 529 - DNA, 53 bp, Artificial Sequence
  Synthetic oligonucleotide
ccacacacacacagcccgagtgtggtgcctcacgtgggctgccccgtgcctac

SEQ ID NO: 530 - DNA, 6 bp, Artificial Sequence
  Synthetic oligonucleotide
ccacag

SEQ ID NO: 531 - DNA, 52 bp, Artificial Sequence
  Synthetic oligonucleotide
ccacagaccccgcacctggaggaggacttgaaggaggtgctgcgttctgagg

SEQ ID NO: 532 - DNA, 29 bp, Artificial Sequence
  Synthetic oligonucleotide
ctggcatcgaactcatcatcgaggacgac

SEQ ID NO: 533 - DNA, 33 bp, Artificial Sequence
  Synthetic oligonucleotide
atcaggcccgagaagcagaagaggaagcctggg

SEQ ID NO: 534 - DNA, 25 bp, Artificial Sequence
  Synthetic oligonucleotide
ctgcggcggagccccatcaagaaag

SEQ ID NO: 535 - DNA, 80 bp, Artificial Sequence
  Synthetic oligonucleotide
tccggaagtctctggctcttgacattgtggatgaggatgtgaagctgatgatgtccacactgcccaagtctctatccttg

SEQ ID NO: 536 - DNA, 29 bp, Artificial Sequence
  Synthetic oligonucleotide
ccgacaactgccccttcaaactcttccag

SEQ ID NO: 537 - DNA, 41 bp, Artificial Sequence
  Synthetic oligonucleotide
atgtccagtgcctggaagacggtggcctgcggggggaccag

SEQ ID NO: 538 - DNA, 25 bp, Artificial Sequence
  Synthetic oligonucleotide
ggagccttctgccaccagcccctcc

SEQ ID NO: 539 - DNA, 23 bp, Artificial Sequence
  Synthetic oligonucleotide
cttctcccaagcccacgtcaggc

SEQ ID NO: 540 - DNA, 62 bp, Artificial Sequence
  Synthetic oligonucleotide
ctggcctcatctcagaccctgcttaggatgggggatgtggccaggggtgctcctgtgctcac

SEQ ID NO: 541 - DNA, 62 bp, Artificial Sequence
  Synthetic oligonucleotide
cctctcttggtgcatttttttggaagaataaaattgcctctctctttgtgctggtctggact

SEQ ID NO: 542 - DNA, 5633 bp, Homo sapiens
aattggtgcctaccatggctggggatacacagtgatggatttgtgacttgctcctctgaaagctggcccaagggtgtacagcatatgaatgtgggggagtttacactacacacgctcttggctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 543 - DNA, 6028 bp, Homo sapiens
gaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 544 - DNA, 5778 bp, Homo sapiens
gaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaaggattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 545 - DNA, 6112 bp, Homo sapiens
tcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 546 - DNA, 5803 bp, Homo sapiens
cagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 547 - DNA, 6140 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagatggctcatgcgagaaagtagcaaaggagaagcttcattcgttctattagtgttagaatgtgctatggaatctggattttattatgattgcaaaaggatggtattgaaaactttggagtggaaaatgacattctgaagtattttgagaatatgaatctgcctgtggagtacagaatggacatagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 548 - DNA, 5792 bp, Homo sapiens
gaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatggaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactatt

SEQ ID NO: 549 - DNA, 2990 bp, Homo sapiens
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgtt

SEQ ID NO: 550 - DNA, 1644 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgca

SEQ ID NO: 551 - DNA, 1327 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatatta

SEQ ID NO: 552 - DNA, 123 bp, Artificial Sequence
  Synthetic oligonucleotide
aattggtgcctaccatggctggggatacacagtgatggatttgtgacttgctcctctgaaagctggcccaagggtgtacagcatatgaatgtgggggagtttacactacacacgctcttggct

SEQ ID NO: 553 - DNA, 214 bp, Artificial Sequence
  Synthetic oligonucleotide
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaaga

SEQ ID NO: 554 - DNA, 171 bp, Artificial Sequence
  Synthetic oligonucleotide
gttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaag

SEQ ID NO: 555 - DNA, 293 bp, Artificial Sequence
  Synthetic oligonucleotide
cagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtct

SEQ ID NO: 556 - DNA, 602 bp, Artificial Sequence
  Synthetic oligonucleotide
tcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcag

SEQ ID NO: 557 - DNA, 268 bp, Artificial Sequence
  Synthetic oligonucleotide
gaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagg

SEQ ID NO: 558 - DNA, 250 bp, Artificial Sequence
  Synthetic oligonucleotide
gtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaat

SEQ ID NO: 559 - DNA, 170 bp, Artificial Sequence
  Synthetic oligonucleotide
attttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatg

SEQ ID NO: 560 - DNA, 675 bp, Artificial Sequence
  Synthetic oligonucleotide
gcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatatta

SEQ ID NO: 561 - DNA, 145 bp, Artificial Sequence
  Synthetic oligonucleotide
gaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacag

SEQ ID NO: 562 - DNA, 184 bp, Artificial Sequence
  Synthetic oligonucleotide
atggctcatgcgagaaagtagcaaaggagaagcttcattcgttctattagtgttagaatgtgctatggaatctggattttattatgattgcaaaaggatggtattgaaaactttggagtggaaaatgacattctgaagtattttgagaatatgaatctgcctgtggagtacagaatggacatag

SEQ ID NO: 563 - DNA, 159 bp, Artificial Sequence
  Synthetic oligonucleotide
gtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggag

SEQ ID NO: 564 - DNA, 162 bp, Artificial Sequence
  Synthetic oligonucleotide
ctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaag

SEQ ID NO: 565 - DNA, 468 bp, Artificial Sequence
  Synthetic oligonucleotide
gtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgca

SEQ ID NO: 566 - DNA, 135 bp, Artificial Sequence
  Synthetic oligonucleotide
gcttgtacagcatatgtggattttatgatttctgtggccagattgattcgtcaggaagaaagattgcccatcgatgaaaaccagcttgctttggaaatgaataaagttatggaattggaaaaagaaattgccaat

SEQ ID NO: 567 - DNA, 137 bp, Artificial Sequence
  Synthetic oligonucleotide
ccattcagctggttgaatttcacaaatgaaatcatgtcaactgtgaatattagtattacaaatgaggaagatgtggttgtttatgctccagaatatttaaccaaacttaagcccattcttaccaaatattctgccag

SEQ ID NO: 568 - DNA, 129 bp, Artificial Sequence
  Synthetic oligonucleotide
gccctttatggtacaacctcagaaacagcaacttggagacgttgtgcaaactatgtcaatgggaatatggaaaatgctgtggggaggctttatgtggaagcagcatttgctggagagagtaaacatgtg

SEQ ID NO: 569 - DNA, 120 bp, Artificial Sequence
  Synthetic oligonucleotide
tcttcccagccggcattctgcagccccccttctttagtgcccagcagtccaactcattgaactatgggggcatcggcatggtcataggacacgaaatcacccatggcttcgatgacaatg

SEQ ID NO: 570 - DNA, 134 bp, Artificial Sequence
  Synthetic oligonucleotide
gcagaaactttaacaaagatggagacctcgttgactggtggactcaacagtctgcaagtaactttaaggagcaatcccagtgcatggtgtatcagtatggaaacttttcctgggacctggcaggtggacagcac

SEQ ID NO: 571 - DNA, 3642 bp, Artificial Sequence
  Synthetic oligonucleotide
gattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgactt

SEQ ID NO: 572 - DNA, 110 bp, Artificial Sequence
  Synthetic oligonucleotide
gagagcgccgagacgcgcggggcgcggagatgtgcaagtggcgaagcttgaccgagagcaggctggagcagccgcccaactcctggcgcgggatctgctgaggggtcacg

SEQ ID NO: 573 - DNA, 61 bp, Artificial Sequence
  Synthetic oligonucleotide
gtgaggggagggagaggggcccagagggtgacctggaggagggctctggaagtcacgtcag

SEQ ID NO: 574 - DNA, 36 bp, Artificial Sequence
  Synthetic oligonucleotide
atggtatttgcaagtcatcagactgcataaaatcag

SEQ ID NO: 575 - DNA, 81 bp, Artificial Sequence
  Synthetic oligonucleotide
atgtccttcaagaacccaaaactgaagatatagtagcagtgcagaaagcaaaagcattgtacaggtcttgtataaatgaat

SEQ ID NO: 576 - DNA, 96 bp, Artificial Sequence
  Synthetic oligonucleotide
ctgctattgatagcagaggtggagaacctctactcaaactgttaccagacatatatgggtggccagtagcaacagaaaactgggagcaaaaatatg

SEQ ID NO: 577 - DNA, 119 bp, Artificial Sequence
  Synthetic oligonucleotide
gtgcttcttggacagctgaaaaagctattgcacaactgaattctaaatatgggaaaaaagtccttattaatttgtttgttggcactgatgataagaattctgtgaatcatgtaattcat

SEQ ID NO: 578 - DNA, 66 bp, Artificial Sequence
  Synthetic oligonucleotide
attgaccaacctcgacttggcctcccttctagagattactatgaatgcactggaatctataaagag

SEQ ID NO: 579 - DNA, 102 bp, Artificial Sequence
  Synthetic oligonucleotide
gctacggctaaacctgaagatcgaaatgatccaatgcttctgtataacaagatgacattggcccagatccaaaataacttttcactagagatcaatgggaag

SEQ ID NO: 580 - DNA, 94 bp, Artificial Sequence
  Synthetic oligonucleotide
agatcttcaaaatttaatgtcctggagattcataatggatcttgtaagcagcctcagccgaacctacaaggagtccagaaatgctttccgcaag

SEQ ID NO: 581 - DNA, 99 bp, Artificial Sequence
  Synthetic oligonucleotide
gtcgaggatttgattgcacagatccgagaagtttttattcagactttagatgacctcacttggatggatgccgagacaaaaaagagagctgaagaaaag

SEQ ID NO: 582 - DNA, 81 bp, Artificial Sequence
  Synthetic oligonucleotide
gccttagcaattaaagaaaggatcggctatcctgatgacattgtttcaaatgataacaaactgaataatgagtacctcgag

SEQ ID NO: 583 - DNA, 104 bp, Artificial Sequence
  Synthetic oligonucleotide
ttgaactacaaagaagatgaatacttcgagaacataattcaaaatttgaaattcagccaaagtaaacaactgaagaagctccgagaaaaggtggacaaagatga

SEQ ID NO: 584 - DNA, 59 bp, Artificial Sequence
  Synthetic oligonucleotide
gtggataagtggagcagctgtagtcaatgcattttactcttcaggaagaaatcagatag

SEQ ID NO: 585 - DNA, 66 bp, Artificial Sequence
  Synthetic oligonucleotide
cttaatggaattaatacactgggagaaaacattgctgataatggaggtcttggtcaagcatacaga

SEQ ID NO: 586 - DNA, 96 bp, Artificial Sequence
  Synthetic oligonucleotide
gcctatcagaattatattaaaaagaatggcgaagaaaaattacttcctggacttgacctaaatcacaaacaactatttttcttgaactttgcacag

SEQ ID NO: 587 - DNA, 77 bp, Artificial Sequence
  Synthetic oligonucleotide
gtgtggtgtggaacctataggccagagtatgcggttaactccattaaaacagatgtgcacagtccaggcaatttcag

SEQ ID NO: 588 - DNA, 8925 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 589 - DNA, 7075 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 590 - DNA, 6949 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 591 - DNA, 7523 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 592 - DNA, 6718 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 593 - DNA, 7048 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 594 - DNA, 10116 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 595 - DNA, 11571 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagaatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 596 - DNA, 12762 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagaatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 597 - DNA, 8721 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 598 - DNA, 9018 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatgggacaggatctccctatgtttcccaggctggtctcaaagtcctggactcaagagatcctcctgtctcagcctcccaaagtgctgggattacaggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 599 - DNA, 10073 bp, Homo sapiens
attcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagagggggataataaacatggaaaaattattctttacatttgtttgccttatatgacattggataaattatattctttacttctataaataatcgtgaggaaaatagtgctcatgttatgttatggttgccatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 600 - DNA, 8791 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 601 - DNA, 8562 bp, Homo sapiens
ctctgccctcatcatgagaccatgcccaggctagtctgctggaaggaagtcagaggcacacggaagagagccacattcagccaaggccattctagaccagttgttccctgtcacttcactaattggccacagcacaagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 602 - DNA, 8851 bp, Homo sapiens
ggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 603 - DNA, 6692 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 604 - DNA, 8601 bp, Homo sapiens
catgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggggtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 605 - DNA, 7436 bp, Homo sapiens
taaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcttattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattcgaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 606 - DNA, 5229 bp, Homo sapiens
atttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 607 - DNA, 5681 bp, Homo sapiens
atcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccgttttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaagaaataacttaataatggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 608 - DNA, 5139 bp, Homo sapiens
atttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtacaacgcttcagcctactgcaaatccaaacacaggtttggtggaagatttggacaggacaggacctctttcaatgacaacgcataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 609 - DNA, 4990 bp, Homo sapiens
gggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 610 - DNA, 5992 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttt

SEQ ID NO: 611 - DNA, 5788 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttt

SEQ ID NO: 612 - DNA, 5672 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtaaggggctgtcctgggggct

SEQ ID NO: 613 - DNA, 5242 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgcattctgtccctgactgttctatagaaagacatcccttgtactctttagagcaaagttggtagctcttatggtcttcatttgaattctaccactgcttctttttctgtttttaagcccatggtaacttggggaaggctttgatgctcttactgttatttctactattatgaaaactcaggttttccaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctatcagtataccttagaaattattttagacagtttgtacttaaagaccagaaagctactttagagacttggaaataatgagcctattgtcaaaaggtggtgcttgcggggcattaggactagagggttggtgaaaatccagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaaga

SEQ ID NO: 614 - DNA, 2405 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagcttt

SEQ ID NO: 615 - DNA, 1136 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagca

SEQ ID NO: 616 - DNA, 475 bp, Homo sapiens
ctctgccctcatcatgagaccatgcccaggctagtctgctggaaggaagtcagaggcacacggaagagagccacattcagccaaggccattctagaccagttgttccctgtcacttcactaattggccacagcacaaggtacacggatggagctggaagccattatcctcagcaaactaatgtaggaacagaaaaccaaatattgcatgttcttacttataagtgggagctgaacaacgagaacacatggacacagggagggaaacaacacacactggggcctgtccagcagtaaggttgaggcagggaaagcattaggaaaaatagctatgcatgctgggctgaatactgggtgatggattgataggtgcagcaaaccaccatggcatatgtttacctttgtaagaaaccagcacatcctgcacatgtaccctggaacttaaaataaaaattaaaatgttttttaaaaaagtca

SEQ ID NO: 617 - DNA, 531 bp, Homo sapiens
ctctgccctcatcatgagaccatgcccaggctagtctgctggaaggaagtcagaggcacacggaagagagccacattcagccaaggccattctagaccagttgttccctgtcacttcactaattggccacagcacaaggttttgttgaagattgaatgagtgtgtaaagtgcccaacagaaagtctggcacatggtacacggatggagctggaagccattatcctcagcaaactaatgtaggaacagaaaaccaaatattgcatgttcttacttataagtgggagctgaacaacgagaacacatggacacagggagggaaacaacacacactggggcctgtccagcagtaaggttgaggcagggaaagcattaggaaaaatagctatgcatgctgggctgaatactgggtgatggattgataggtgcagcaaaccaccatggcatatgtttacctttgtaagaaaccagcacatcctgcacatgtaccctggaacttaaaataaaaattaaaatgttttttaaaaaagtca

SEQ ID NO: 618 - DNA, 138 bp, Artificial Sequence
  Synthetic oligonucleotide
ctctgccctcatcatgagaccatgcccaggctagtctgctggaaggaagtcagaggcacacggaagagagccacattcagccaaggccattctagaccagttgttccctgtcacttcactaattggccacagcacaag

SEQ ID NO: 619 - DNA, 337 bp, Artificial Sequence
  Synthetic oligonucleotide
gtacacggatggagctggaagccattatcctcagcaaactaatgtaggaacagaaaaccaaatattgcatgttcttacttataagtgggagctgaacaacgagaacacatggacacagggagggaaacaacacacactggggcctgtccagcagtaaggttgaggcagggaaagcattaggaaaaatagctatgcatgctgggctgaatactgggtgatggattgataggtgcagcaaaccaccatggcatatgtttacctttgtaagaaaccagcacatcctgcacatgtaccctggaacttaaaataaaaattaaaatgttttttaaaaaagtca

SEQ ID NO: 620 - DNA, 333 bp, Artificial Sequence
  Synthetic oligonucleotide
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccag

SEQ ID NO: 621 - DNA, 593 bp, Artificial Sequence
  Synthetic oligonucleotide
ggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacag

SEQ ID NO: 622 - DNA, 477 bp, Artificial Sequence
  Synthetic oligonucleotide
catgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggggtttcggaaaaagaaagttatttggaataagttatagtaaaactccattctaactgactaataaaaatgagggtagattttcctcatgtttttaaagggttctcatcctttttttcctacctcatag

SEQ ID NO: 623 - DNA, 138 bp, Artificial Sequence
  Synthetic oligonucleotide
ctattgttaaccgtgatggcacccgctatgtccagaaaggagaatacagaacgaatcctgaagacatctaccccagcaaccctactgatgatgacgtgagcagcggctcctccagtgaaaggagcagcacttcaggag

SEQ ID NO: 624 - DNA, 1304 bp, Artificial Sequence
  Synthetic oligonucleotide
gtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagcttt

SEQ ID NO: 625 - DNA, 2249 bp, Artificial Sequence
  Synthetic oligonucleotide
attcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagagggggataataaacatggaaaaattattctttacatttgtttgccttatatgacattggataaattatattctttacttctataaataatcgtgaggaaaatagtgctcatgttatgttatggttgccatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacag

SEQ ID NO: 626 - DNA, 129 bp, Artificial Sequence
  Synthetic oligonucleotide
ctttgatgagcactagtgctacagcaactgagacagcaaccaagaggcaagaaacctgggattggttttcatggttgtttctaccatcagagtcaaagaatcatcttcacacaacaacacaaatggctg

SEQ ID NO: 627 - DNA, 494 bp, Artificial Sequence
  Synthetic oligonucleotide
gtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttt

SEQ ID NO: 628 - DNA, 310 bp, Artificial Sequence
  Synthetic oligonucleotide
ttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatg

SEQ ID NO: 629 - DNA, 252 bp, Artificial Sequence
  Synthetic oligonucleotide
attatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacag

SEQ ID NO: 630 - DNA, 1113 bp, Artificial Sequence
  Synthetic oligonucleotide
taaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcttattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattcgaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacag

SEQ ID NO: 631 - DNA, 475 bp, Artificial Sequence
  Synthetic oligonucleotide
gtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcag

SEQ ID NO: 632 - DNA, 1934 bp, Artificial Sequence
  Synthetic oligonucleotide
gtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgcattctgtccctgactgttctatagaaagacatcccttgtactctttagagcaaagttggtagctcttatggtcttcatttgaattctaccactgcttctttttctgtttttaagcccatggtaacttggggaaggctttgatgctcttactgttatttctactattatgaaaactcaggttttccaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctatcagtataccttagaaattattttagacagtttgtacttaaagaccagaaagctactttagagacttggaaataatgagcctattgtcaaaaggtggtgcttgcggggcattaggactagagggttggtgaaaatccagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaaga

SEQ ID NO: 633 - DNA, 129 bp, Artificial Sequence
  Synthetic oligonucleotide
tccaggcaactcctagtagtacaacggaagaaacagctacccagaaggaacagtggtttggcaacagatggcatgagggatatcgccaaacacccagagaagactcccattcgacaacagggacagctg

SEQ ID NO: 634 - DNA, 1144 bp, Artificial Sequence
  Synthetic oligonucleotide
gtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttag

SEQ ID NO: 635 - DNA, 327 bp, Artificial Sequence
  Synthetic oligonucleotide
gggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacag

SEQ ID NO: 636 - DNA, 132 bp, Artificial Sequence
  Synthetic oligonucleotide
cagcctcagctcataccagccatccaatgcaaggaaggacaacaccaagcccagaggacagttcctggactgatttcttcaacccaatctcacaccccatgggacgaggtcatcaagcaggaagaaggatgg

SEQ ID NO: 637 - DNA, 1344 bp, Artificial Sequence
  Synthetic oligonucleotide
atttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcag

SEQ ID NO: 638 - DNA, 893 bp, Artificial Sequence
  Synthetic oligonucleotide
atcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccgttttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaagaaataacttaataatggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttag

SEQ ID NO: 639 - DNA, 1095 bp, Artificial Sequence
  Synthetic oligonucleotide
ctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacag

SEQ ID NO: 640 - DNA, 186 bp, Artificial Sequence
  Synthetic oligonucleotide
gtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcag

SEQ ID NO: 641 - DNA, 1398 bp, Artificial Sequence
  Synthetic oligonucleotide
gtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaaga

SEQ ID NO: 642 - DNA, 1248 bp, Artificial Sequence
  Synthetic oligonucleotide
atcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacag

SEQ ID NO: 643 - DNA, 1715 bp, Artificial Sequence
  Synthetic oligonucleotide
gggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattag

SEQ ID NO: 644 - DNA, 1253 bp, Artificial Sequence
  Synthetic oligonucleotide
cggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtctta

SEQ ID NO: 645 - DNA, 1666 bp, Artificial Sequence
  Synthetic oligonucleotide
caataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaag

SEQ ID NO: 646 - DNA, 281 bp, Artificial Sequence
  Synthetic oligonucleotide
aataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 647 - DNA, 56 bp, Artificial Sequence
  Synthetic oligonucleotide
gttttgttgaagattgaatgagtgtgtaaagtgcccaacagaaagtctggcacatg

SEQ ID NO: 648 - DNA, 97 bp, Artificial Sequence
  Synthetic oligonucleotide
gttcggtccgccatcctcgtcccgtcctccgccggcccctgccccgcgcccagggatcctccagctcctttcgcccgcgccctccgttcgctccgga

SEQ ID NO: 649 - DNA, 71 bp, Artificial Sequence
  Synthetic oligonucleotide
caccatggacaagttttggtggcacgcagcctggggactctgcctcgtgccgctgagcctggcgcagatcg

SEQ ID NO: 650 - DNA, 27 bp, Artificial Sequence
  Synthetic oligonucleotide
atttgaatataacctgccgctttgcag

SEQ ID NO: 651 - DNA, 45 bp, Artificial Sequence
  Synthetic oligonucleotide
gtgtattccacgtggagaaaaatggtcgctacagcatctctcgga

SEQ ID NO: 652 - DNA, 37 bp, Artificial Sequence
  Synthetic oligonucleotide
cggaggccgctgacctctgcaaggctttcaatagcac

SEQ ID NO: 653 - DNA, 57 bp, Artificial Sequence
  Synthetic oligonucleotide
cttgcccacaatggcccagatggagaaagctctgagcatcggatttgagacctgcag

SEQ ID NO: 654 - DNA, 43 bp, Artificial Sequence
  Synthetic oligonucleotide
gtatgggttcatagaagggcacgtggtgattccccggatccac

SEQ ID NO: 655 - DNA, 13 bp, Artificial Sequence
  Synthetic oligonucleotide
cccaactccatct

SEQ ID NO: 656 - DNA, 26 bp, Artificial Sequence
  Synthetic oligonucleotide
gtgcagcaaacaacacaggggtgtac

SEQ ID NO: 657 - DNA, 52 bp, Artificial Sequence
  Synthetic oligonucleotide
atcctcacatccaacacctcccagtatgacacatattgcttcaatgcttcag

SEQ ID NO: 658 - DNA, 35 bp, Artificial Sequence
  Synthetic oligonucleotide
ctccacctgaagaagattgtacatcagtcacagac

SEQ ID NO: 659 - DNA, 34 bp, Artificial Sequence
  Synthetic oligonucleotide
ctgcccaatgcctttgatggaccaattaccataa

SEQ ID NO: 660 - DNA, 42 bp, Artificial Sequence
  Synthetic oligonucleotide
gttacatcttttacaccttttctactgtacaccccatcccag

SEQ ID NO: 661 - DNA, 51 bp, Artificial Sequence
  Synthetic oligonucleotide
acgaagacagtccctggatcaccgacagcacagacagaatccctgctacca

SEQ ID NO: 662 - DNA, 115 bp, Artificial Sequence
  Synthetic oligonucleotide
tagtaaagagacatcttctacagtaaccactgagaagaagtggaagtttttcatctcctttttttattcaaaaagaaaaagaatttctcaatttctgaaccacagttcactttag

SEQ ID NO: 663 - DNA, 75 bp, Artificial Sequence
  Synthetic oligonucleotide
gttaatgagttaataataaacatatctgaaagtgtgggggagttttcattagcctttaaaaacttatatggtgag

SEQ ID NO: 664 - DNA, 27 bp, Artificial Sequence
  Synthetic oligonucleotide
gtacgtcttcaaataccatctcagcag

SEQ ID NO: 665 - DNA, 99 bp, Artificial Sequence
  Synthetic oligonucleotide
gctgggagccaaatgaagaaaatgaagatgaaagagacagacacctcagtttttctggatcaggcattgatgatgatgaagattttatctccagcacca

SEQ ID NO: 666 - DNA, 114 bp, Artificial Sequence
  Synthetic oligonucleotide
tttcaaccacaccacgggcttttgaccacacaaaacagaaccaggactggacccagtggaacccaagccattcaaatccggaagtgctacttcagacaaccacaaggatgactg

SEQ ID NO: 667 - DNA, 117 bp, Artificial Sequence
  Synthetic oligonucleotide
atgtagacagaaatggcaccactgcttatgaaggaaactggaacccagaagcacaccctcccctcattcaccatgagcatcatgaggaagaagagaccccacattctacaagcacaa

SEQ ID NO: 668 - DNA, 84 bp, Artificial Sequence
  Synthetic oligonucleotide
atatggactccagtcatagtacaacgcttcagcctactgcaaatccaaacacaggtttggtggaagatttggacaggacaggac

SEQ ID NO: 669 - DNA, 18 bp, Artificial Sequence
  Synthetic oligonucleotide
ctctttcaatgacaacgc

SEQ ID NO: 670 - DNA, 90 bp, Artificial Sequence
  Synthetic oligonucleotide
agcagagtaattctcagagcttctctacatcacatgaaggcttggaagaagataaagaccatccaacaacttctactctgacatcaagca

SEQ ID NO: 671 - DNA, 96 bp, Artificial Sequence
  Synthetic oligonucleotide
gtaaggattataaaacctagttggcttcagctattgataagaatcaatcaattatgggtacttttgcagtgtctttggtggaggtgcatccattag

SEQ ID NO: 672 - DNA, 18 bp, Artificial Sequence
  Synthetic oligonucleotide
ataggaatgatgtcacag

SEQ ID NO: 673 - DNA, 40 bp, Artificial Sequence
  Synthetic oligonucleotide
gagaccaagacacattccaccccagtggggggtcccatac

SEQ ID NO: 674 - DNA, 23 bp, Artificial Sequence
  Synthetic oligonucleotide
cactcatggatctgaatcagatg

SEQ ID NO: 675 - DNA, 93 bp, Artificial Sequence
  Synthetic oligonucleotide
ggacaggatctccctatgtttcccaggctggtctcaaagtcctggactcaagagatcctcctgtctcagcctcccaaagtgctgggattacag

SEQ ID NO: 676 - DNA, 24 bp, Artificial Sequence
  Synthetic oligonucleotide
gacactcacatgggagtcaagaag

SEQ ID NO: 677 - DNA, 48 bp, Artificial Sequence
  Synthetic oligonucleotide
gtggagcaaacacaacctctggtcctataaggacaccccaaattccag

SEQ ID NO: 678 - DNA, 26 bp, Artificial Sequence
  Synthetic oligonucleotide
aatggctgatcatcttggcatccctc

SEQ ID NO: 679 - DNA, 25 bp, Artificial Sequence
  Synthetic oligonucleotide
ttggccttggctttgattcttgcag

SEQ ID NO: 680 - DNA, 12 bp, Artificial Sequence
  Synthetic oligonucleotide
tttgcattgcag

SEQ ID NO: 681 - DNA, 16 bp, Artificial Sequence
  Synthetic oligonucleotide
tcaacagtcgaagaag

SEQ ID NO: 682 - DNA, 22 bp, Artificial Sequence
  Synthetic oligonucleotide
gtaaggggctgtcctgggggct

SEQ ID NO: 683 - DNA, 75 bp, Artificial Sequence
  Synthetic oligonucleotide
gtgtgggcagaagaaaaagctagtgatcaacagtggcaatggagctgtggaggacagaaagccaagtggactcaa

SEQ ID NO: 684 - DNA, 3616 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctg

SEQ ID NO: 685 - DNA, 3663 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctg

SEQ ID NO: 686 - DNA, 4022 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctg

SEQ ID NO: 687 - DNA, 3975 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctg

SEQ ID NO: 688 - DNA, 2690 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagcgtgaaggacctgggctctgg

SEQ ID NO: 689 - DNA, 2770 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccaggtgaggtctacccgcccaccgctgaccctgccaccgtcctgcccagcggccactgacaggttttctttcccttctggcagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagcgtgaaggacctgggctctgg

SEQ ID NO: 690 - DNA, 2067 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctcc

SEQ ID NO: 691 - DNA, 2514 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctcc

SEQ ID NO: 692 - DNA, 2354 bp, Homo sapiens
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcaggtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtggg

SEQ ID NO: 693 - DNA, 494 bp, Artificial Sequence
  Synthetic oligonucleotide
gtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtag

SEQ ID NO: 694 - DNA, 359 bp, Artificial Sequence
  Synthetic oligonucleotide
gtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcag

SEQ ID NO: 695 - DNA, 447 bp, Artificial Sequence
  Synthetic oligonucleotide
gtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccag

SEQ ID NO: 696 - DNA, 213 bp, Artificial Sequence
  Synthetic oligonucleotide
gtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtggg

SEQ ID NO: 697 - DNA, 265 bp, Artificial Sequence
  Synthetic oligonucleotide
gtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctcc

SEQ ID NO: 698 - DNA, 218 bp, Artificial Sequence
  Synthetic oligonucleotide
gtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagcgtgaaggacctgggctctgg

SEQ ID NO: 699 - DNA, 469 bp, Artificial Sequence
  Synthetic oligonucleotide
ctgtgcggtgtcaccatgagcacctccagctgtactagtgccattggaataataaatttgataaggtggtgactctgttctgcatttttcacggtgtcttcgcaggggagcggggctgcccagtactgggctccctggagcctagaaggggacccgggccctagttaggtgcagcctggggctgcctcagtgttaggtggaacgttctggaatggtgggaatgccctacccctgtgtcattcagagaagcagctgccagctgcgcgggtctgctgagcatttgaagtaggatcagtgcggcaaggaattacgagatgtcactttgaacgcatttggatggccctgtggagcgaggggctctggattgaacttcgcaggtttcagcaactttccgaattgctgacgagctcacaagttctatctgccatcaggattttctgtggtcaccccagtcctgactagtttatta

SEQ ID NO: 700 - DNA, 92 bp, Artificial Sequence
  Synthetic oligonucleotide
agcgttctcttccgccgtcgtcgccgccatcctcggcgcgactcgcttctttcggttctacctgggagaatccaccgccatccgccaccatg

SEQ ID NO: 701 - DNA, 38 bp, Artificial Sequence
  Synthetic oligonucleotide
gtgaacttcacggtagaccagatccgcgccatcatgga

SEQ ID NO: 702 - DNA, 22 bp, Artificial Sequence
  Synthetic oligonucleotide
caagaaggccaacatccgcaac

SEQ ID NO: 703 - DNA, 54 bp, Artificial Sequence
  Synthetic oligonucleotide
atgtctgtcatcgcccacgtggaccatggcaagtccacgctgacagactccctg

SEQ ID NO: 704 - DNA, 101 bp, Artificial Sequence
  Synthetic oligonucleotide
gtgtgcaaggcgggcatcatcgcctcggcccgggccggggagacacgcttcactgatacccggaaggacgagcaggagcgttgcatcaccatcaagtcaac

SEQ ID NO: 705 - DNA, 22 bp, Artificial Sequence
  Synthetic oligonucleotide
tgccatctccctcttctacgag

SEQ ID NO: 706 - DNA, 71 bp, Artificial Sequence
  Synthetic oligonucleotide
ctctcggagaatgacttgaacttcatcaagcagagcaaggacggtgccggcttcctcatcaacctcattga

SEQ ID NO: 707 - DNA, 21 bp, Artificial Sequence
  Synthetic oligonucleotide
ctcccccgggcatgtcgactt

SEQ ID NO: 708 - DNA, 29 bp, Artificial Sequence
  Synthetic oligonucleotide
ctcctcggaggtgactgctgccctccgag

SEQ ID NO: 709 - DNA, 4 bp, Artificial Sequence
  Synthetic oligonucleotide
tcac

SEQ ID NO: 710 - DNA, 35 bp, Artificial Sequence
  Synthetic oligonucleotide
cgatggcgcattggtggtggtggactgcgtgtcag

SEQ ID NO: 711 - DNA, 23 bp, Artificial Sequence
  Synthetic oligonucleotide
gcgtgtgcgtgcagacggagaca

SEQ ID NO: 712 - DNA, 29 bp, Artificial Sequence
  Synthetic oligonucleotide
gtgctgcggcaggccattgccgagcgcat

SEQ ID NO: 713 - DNA, 58 bp, Artificial Sequence
  Synthetic oligonucleotide
caagcctgtgctgatgatgaacaagatggaccgcgccctgctggagctgcagctggag

SEQ ID NO: 714 - DNA, 102 bp, Artificial Sequence
  Synthetic oligonucleotide
cccgaggagctctaccagactttccagcgcatcgtggagaacgtgaacgtcatcatctccacctacggcgagggcgagagcggccccatgggcaacatcatg

SEQ ID NO: 715 - DNA, 78 bp, Artificial Sequence
  Synthetic oligonucleotide
atcgatcctgtcctcggtaccgtgggctttgggtctggcctccacgggtgggccttcaccctgaagcagtttgccgag

SEQ ID NO: 716 - DNA, 19 bp, Artificial Sequence
  Synthetic oligonucleotide
atgtatgtggccaagttcg

SEQ ID NO: 717 - DNA, 4 bp, Artificial Sequence
  Synthetic oligonucleotide
ccgc

SEQ ID NO: 718 - DNA, 34 bp, Artificial Sequence
  Synthetic oligonucleotide
caagggggagggccagttggggcctgccgagcgg

SEQ ID NO: 719 - DNA, 30 bp, Artificial Sequence
  Synthetic oligonucleotide
gccaagaaagtagaggacatgatgaagaag

SEQ ID NO: 720 - DNA, 14 bp, Artificial Sequence
  Synthetic oligonucleotide
ctgtggggtgacag

SEQ ID NO: 721 - DNA, 99 bp, Artificial Sequence
  Synthetic oligonucleotide
gtactttgacccagccaacggcaagttcagcaagtcagccaccagccccgaagggaagaagctgccacgcaccttctgccagctgatcctggaccccat

SEQ ID NO: 722 - DNA, 7 bp, Artificial Sequence
  Synthetic oligonucleotide
cttcaag

SEQ ID NO: 723 - DNA, 27 bp, Artificial Sequence
  Synthetic oligonucleotide
gtgtttgatgcgatcatgaatttcaag

SEQ ID NO: 724 - DNA, 6 bp, Artificial Sequence
  Synthetic oligonucleotide
aaagag

SEQ ID NO: 725 - DNA, 7 bp, Artificial Sequence
  Synthetic oligonucleotide
gagacag

SEQ ID NO: 726 - DNA, 5 bp, Artificial Sequence
  Synthetic oligonucleotide
caaaa

SEQ ID NO: 727 - DNA, 12 bp, Artificial Sequence
  Synthetic oligonucleotide
ctgatagagaaa

SEQ ID NO: 728 - DNA, 24 bp, Artificial Sequence
  Synthetic oligonucleotide
ctggacatcaaactggacagcgag

SEQ ID NO: 729 - DNA, 16 bp, Artificial Sequence
  Synthetic oligonucleotide
gacaaggacaaagaag

SEQ ID NO: 730 - DNA, 17 bp, Artificial Sequence
  Synthetic oligonucleotide
gcaaacccctgctgaag

SEQ ID NO: 731 - DNA, 12 bp, Artificial Sequence
  Synthetic oligonucleotide
gctgtgatgcgc

SEQ ID NO: 732 - DNA, 23 bp, Artificial Sequence
  Synthetic oligonucleotide
cgctggctgcctgccggagacgc

SEQ ID NO: 733 - DNA, 25 bp, Artificial Sequence
  Synthetic oligonucleotide
cttgttgcagatgatcaccatccac

SEQ ID NO: 734 - DNA, 10 bp, Artificial Sequence
  Synthetic oligonucleotide
ctgccctccc

SEQ ID NO: 735 - DNA, 16 bp, Artificial Sequence
  Synthetic oligonucleotide
ctgtgacggcccagaa

SEQ ID NO: 736 - DNA, 6 bp, Artificial Sequence
  Synthetic oligonucleotide
gtaccg

SEQ ID NO: 737 - DNA, 38 bp, Artificial Sequence
  Synthetic oligonucleotide
ctgcgagctcctgtacgaggggcccccggacgacgagg

SEQ ID NO: 738 - DNA, 9 bp, Artificial Sequence
  Synthetic oligonucleotide
ctgccatgg

SEQ ID NO: 739 - DNA, 27 bp, Artificial Sequence
  Synthetic oligonucleotide
gcattaaaagctgtgaccccaaaggcc

SEQ ID NO: 740 - DNA, 115 bp, Artificial Sequence
  Synthetic oligonucleotide
ctcttatgatgtatatttccaaaatggtgccaacctccgacaaaggtcggttctacgcctttggacgagtcttctcggggctggtctccactggcctgaaggtcaggatcatggg

SEQ ID NO: 741 - DNA, 22 bp, Artificial Sequence
  Synthetic oligonucleotide
gcccaactatacccctgggaag

SEQ ID NO: 742 - DNA, 32 bp, Artificial Sequence
  Synthetic oligonucleotide
aaggaggacctctacctgaagccaatccagag

SEQ ID NO: 743 - DNA, 21 bp, Artificial Sequence
  Synthetic oligonucleotide
aacaatcttgatgatgggccg

SEQ ID NO: 744 - DNA, 29 bp, Artificial Sequence
  Synthetic oligonucleotide
ctacgtggagcccatcgaggatgtgcctt

SEQ ID NO: 745 - DNA, 14 bp, Artificial Sequence
  Synthetic oligonucleotide
gtgggaacattgtg

SEQ ID NO: 746 - DNA, 6 bp, Artificial Sequence
  Synthetic oligonucleotide
ggcctc

SEQ ID NO: 747 - DNA, 54 bp, Artificial Sequence
  Synthetic oligonucleotide
gtgggcgtggaccagttcctggtgaagacgggcaccatcaccaccttcgagcac

SEQ ID NO: 748 - DNA, 24 bp, Artificial Sequence
  Synthetic oligonucleotide
gcgcacaacatgcgggtgatgaag

SEQ ID NO: 749 - DNA, 6 bp, Artificial Sequence
  Synthetic oligonucleotide
ttcagc

SEQ ID NO: 750 - DNA, 7 bp, Artificial Sequence
  Synthetic oligonucleotide
gtcagcc

SEQ ID NO: 751 - DNA, 98 bp, Artificial Sequence
  Synthetic oligonucleotide
ctgttgtcagagtggccgtggaggccaagaacccggctgacctgcccaagctggtggaggggctgaagcggctggccaagtccgaccccatggtgcag

SEQ ID NO: 752 - DNA, 27 bp, Artificial Sequence
  Synthetic oligonucleotide
tgcatcatcgaggagtcgggagagcac

SEQ ID NO: 753 - DNA, 9 bp, Artificial Sequence
  Synthetic oligonucleotide
atcatcgcg

SEQ ID NO: 754 - DNA, 30 bp, Artificial Sequence
  Synthetic oligonucleotide
ggcgccggcgagctgcacctggagatctgc

SEQ ID NO: 755 - DNA, 9 bp, Artificial Sequence
  Synthetic oligonucleotide
ctgaaggac

SEQ ID NO: 756 - DNA, 6 bp, Artificial Sequence
  Synthetic oligonucleotide
ctggag

SEQ ID NO: 757 - DNA, 20 bp, Artificial Sequence
  Synthetic oligonucleotide
gaggaccacgcctgcatccc

SEQ ID NO: 758 - DNA, 7 bp, Artificial Sequence
  Synthetic oligonucleotide
catcaag

SEQ ID NO: 759 - DNA, 78 bp, Artificial Sequence
  Synthetic oligonucleotide
aaatctgacccggtcgtctcgtaccgcgagacggtcagtgaagagtcgaacgtgctctgcctctccaagtcccccaac

SEQ ID NO: 760 - DNA, 12 bp, Artificial Sequence
  Synthetic oligonucleotide
aagcacaaccgg

SEQ ID NO: 761 - DNA, 8 bp, Artificial Sequence
  Synthetic oligonucleotide
ctgtacat

SEQ ID NO: 762 - DNA, 4 bp, Artificial Sequence
  Synthetic oligonucleotide
gaag

SEQ ID NO: 763 - DNA, 8 bp, Artificial Sequence
  Synthetic oligonucleotide
gcgcggcc

SEQ ID NO: 764 - DNA, 5 bp, Artificial Sequence
  Synthetic oligonucleotide
cttcc

SEQ ID NO: 765 - DNA, 5 bp, Artificial Sequence
  Synthetic oligonucleotide
ccgac

SEQ ID NO: 766 - DNA, 12 bp, Artificial Sequence
  Synthetic oligonucleotide
ggcctggccgag

SEQ ID NO: 767 - DNA, 13 bp, Artificial Sequence
  Synthetic oligonucleotide
gacatcgataaag

SEQ ID NO: 768 - DNA, 32 bp, Artificial Sequence
  Synthetic oligonucleotide
gcgaggtgtccgcccgtcaggagctcaagcag

SEQ ID NO: 769 - DNA, 36 bp, Artificial Sequence
  Synthetic oligonucleotide
cgggcgcgctacctggccgagaagtacgagtgggac

SEQ ID NO: 770 - DNA, 4 bp, Artificial Sequence
  Synthetic oligonucleotide
gtgg

SEQ ID NO: 771 - DNA, 11 bp, Artificial Sequence
  Synthetic oligonucleotide
ctgaggcccgc

SEQ ID NO: 772 - DNA, 39 bp, Artificial Sequence
  Synthetic oligonucleotide
aagatctggtgctttgggcccgacggcaccggccccaac

SEQ ID NO: 773 - DNA, 21 bp, Artificial Sequence
  Synthetic oligonucleotide
atcctcaccgacatcaccaag

SEQ ID NO: 774 - DNA, 66 bp, Artificial Sequence
  Synthetic oligonucleotide
ggtgtgcagtacctcaacgagatcaaggacagtgtggtggccggcttccagtgggccaccaaggag

SEQ ID NO: 775 - DNA, 100 bp, Artificial Sequence
  Synthetic oligonucleotide
ggcgcactgtgtgaggagaacatgcggggtgtgcgcttcgacgtccacgacgtcaccctgcacgccgacgccatccaccgcggagggggccagatcatcc

SEQ ID NO: 776 - DNA, 6 bp, Artificial Sequence
  Synthetic oligonucleotide
ccacag

SEQ ID NO: 777 - DNA, 19 bp, Artificial Sequence
  Synthetic oligonucleotide
cacggcgctgcctctacgc

SEQ ID NO: 778 - DNA, 39 bp, Artificial Sequence
  Synthetic oligonucleotide
cagtgtgctgaccgcccagccacgcctcatggagcccat

SEQ ID NO: 779 - DNA, 4 bp, Artificial Sequence
  Synthetic oligonucleotide
ctac

SEQ ID NO: 780 - DNA, 15 bp, Artificial Sequence
  Synthetic oligonucleotide
cttgtggagatccag

SEQ ID NO: 781 - DNA, 80 bp, Artificial Sequence
  Synthetic oligonucleotide
gtgaggtctacccgcccaccgctgaccctgccaccgtcctgcccagcggccactgacaggttttctttcccttctggcag

SEQ ID NO: 782 - DNA, 47 bp, Artificial Sequence
  Synthetic oligonucleotide
tgtccagagcaggtggtcggtggcatctacggggttttgaacaggaa

SEQ ID NO: 783 - DNA, 15 bp, Artificial Sequence
  Synthetic oligonucleotide
gcggggccacgtgtt

SEQ ID NO: 784 - DNA, 6 bp, Artificial Sequence
  Synthetic oligonucleotide
cgagga

SEQ ID NO: 785 - DNA, 7 bp, Artificial Sequence
  Synthetic oligonucleotide
gtcccag

SEQ ID NO: 786 - DNA, 5 bp, Artificial Sequence
  Synthetic oligonucleotide
gtggc

SEQ ID NO: 787 - DNA, 6 bp, Artificial Sequence
  Synthetic oligonucleotide
cggcac

SEQ ID NO: 788 - DNA, 6 bp, Artificial Sequence
  Synthetic oligonucleotide
ccccat

SEQ ID NO: 789 - DNA, 41 bp, Artificial Sequence
  Synthetic oligonucleotide
gtttgtggtcaaggcctatctgcccgtcaacgagtcctttg

SEQ ID NO: 790 - DNA, 74 bp, Artificial Sequence
  Synthetic oligonucleotide
gcttcaccgctgacctgaggtccaacacgggcggccaggcgttcccccagtgtgtgtttgaccactggcagatc

SEQ ID NO: 791 - DNA, 7 bp, Artificial Sequence
  Synthetic oligonucleotide
ctgcccg

SEQ ID NO: 792 - DNA, 7 bp, Artificial Sequence
  Synthetic oligonucleotide
gagaccc

SEQ ID NO: 793 - DNA, 28 bp, Artificial Sequence
  Synthetic oligonucleotide
cttcgacaacagcagccgccccagccag

SEQ ID NO: 794 - DNA, 7 bp, Artificial Sequence
  Synthetic oligonucleotide
gtggtgg

SEQ ID NO: 795 - DNA, 9 bp, Artificial Sequence
  Synthetic oligonucleotide
cggagaccc

SEQ ID NO: 796 - DNA, 35 bp, Artificial Sequence
  Synthetic oligonucleotide
gcaagcgcaagggcctgaaagaaggcatccctgcc

SEQ ID NO: 797 - DNA, 27 bp, Artificial Sequence
  Synthetic oligonucleotide
ctggacaacttcctggacaaattgtag

SEQ ID NO: 798 - DNA, 6 bp, Artificial Sequence
  Synthetic oligonucleotide
gcggcc

SEQ ID NO: 799 - DNA, 10 bp, Artificial Sequence
  Synthetic oligonucleotide
cttcctgcag

SEQ ID NO: 800 - DNA, 11 bp, Artificial Sequence
  Synthetic oligonucleotide
cgcctgccgcc

SEQ ID NO: 801 - DNA, 4 bp, Artificial Sequence
  Synthetic oligonucleotide
ccgg

SEQ ID NO: 802 - DNA, 4 bp, Artificial Sequence
  Synthetic oligonucleotide
ggac

SEQ ID NO: 803 - DNA, 9 bp, Artificial Sequence
  Synthetic oligonucleotide
tcgcagcac

SEQ ID NO: 804 - DNA, 6 bp, Artificial Sequence
  Synthetic oligonucleotide
ccacag

SEQ ID NO: 805 - DNA, 6 bp, Artificial Sequence
  Synthetic oligonucleotide
caccac

SEQ ID NO: 806 - DNA, 16 bp, Artificial Sequence
  Synthetic oligonucleotide
gtcctcgaattctcag

SEQ ID NO: 807 - DNA, 7 bp, Artificial Sequence
  Synthetic oligonucleotide
acgacac

SEQ ID NO: 808 - DNA, 31 bp, Artificial Sequence
  Synthetic oligonucleotide
ctggagactgtcccgacacagcgacgctccc

SEQ ID NO: 809 - DNA, 7 bp, Artificial Sequence
  Synthetic oligonucleotide
ctgagag

SEQ ID NO: 810 - DNA, 14 bp, Artificial Sequence
  Synthetic oligonucleotide
gtttctggggcccg

SEQ ID NO: 811 - DNA, 13 bp, Artificial Sequence
  Synthetic oligonucleotide
ctgcgtgccatca

SEQ ID NO: 812 - DNA, 14 bp, Artificial Sequence
  Synthetic oligonucleotide
ctcaaccataacac

SEQ ID NO: 813 - DNA, 17 bp, Artificial Sequence
  Synthetic oligonucleotide
ttgatgccgtttctttc

SEQ ID NO: 814 - DNA, 21 bp, Artificial Sequence
  Synthetic oligonucleotide
aatatttatttccagagtccg

SEQ ID NO: 815 - DNA, 10 bp, Artificial Sequence
  Synthetic oligonucleotide
gaggcagcag

SEQ ID NO: 816 - DNA, 4 bp, Artificial Sequence
  Synthetic oligonucleotide
acac

SEQ ID NO: 817 - DNA, 4 bp, Artificial Sequence
  Synthetic oligonucleotide
gccc

SEQ ID NO: 818 - DNA, 22 bp, Artificial Sequence
  Synthetic oligonucleotide
tcttagtagggacttaatgggc

SEQ ID NO: 819 - DNA, 11 bp, Artificial Sequence
  Synthetic oligonucleotide
cggtcggggag

SEQ ID NO: 820 - DNA, 6 bp, Artificial Sequence
  Synthetic oligonucleotide
ggggag

SEQ ID NO: 821 - DNA, 14 bp, Artificial Sequence
  Synthetic oligonucleotide
gcgggatgggacac

SEQ ID NO: 822 - DNA, 7 bp, Artificial Sequence
  Synthetic oligonucleotide
ccaacac

SEQ ID NO: 823 - DNA, 24 bp, Artificial Sequence
  Synthetic oligonucleotide
tttttccatttcttcagagggaaa

SEQ ID NO: 824 - DNA, 32 bp, Artificial Sequence
  Synthetic oligonucleotide
ctcagatgtccaaactaattttaacaaacgca

SEQ ID NO: 825 - DNA, 7 bp, Artificial Sequence
  Synthetic oligonucleotide
ttaagag

SEQ ID NO: 826 - DNA, 25 bp, Artificial Sequence
  Synthetic oligonucleotide
gtttatttgggtacatggcccgcag

SEQ ID NO: 827 - DNA, 15 bp, Artificial Sequence
  Synthetic oligonucleotide
tggcttttgccccag

SEQ ID NO: 828 - DNA, 17 bp, Artificial Sequence
  Synthetic oligonucleotide
aaaggggaaaggaacac

SEQ ID NO: 829 - DNA, 32 bp, Artificial Sequence
  Synthetic oligonucleotide
gcgggtagatgatttctagcaggcaggaagtc

SEQ ID NO: 830 - DNA, 3788 bp, Homo sapiens
ggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagaacctcagagtgacagagccaaaagaccagtgcctcattttgctgacatggaaaaggaaacttcgtgggggaaagagatctgcttgcagtcggccagagagacagaaccagggcagtgaccctactcccacccgaaacacacagcccctgacacagagctgggcatgtgtgggctctcactagcgctggctgaactgcctgcaccggcagggcatctggcctccttcagcggagagggcccagcaagcaggactccgaccgcctccactactccagctgaattccagcccctgctctcccgtctccaggtcagaacatcagcatttgaacttgagtacttcccccatgcctgtcctgcgggacttggggcttgtactccctctgaggttggaccaccctgaattggggttttccagctagaagaatccctccacagaagcttgaattttccttctgttctctcctttgctctgtacttctcagcaaaaagcatcacctataaatgtgaaggctgattaattctaagtctggggctagtgttaatacagacacagctggcgagatacagaattaaataaacacaaggtcctctgctgactcagcagttggtggaacaggggataagcccttgggcattctagaaagttctgcctgcccagtggtaattttccctttcaggtttcttacctggaaagaaattcccagccactcttgccagcctgtctatttcactaagccagagaacatattttgttgtaagagatttgaacattactttctgctctcaagggacccccctctatcaagtccaattttctgtccctgcctttaccattagagagtctctttggtggagcaaggcagtaccctctctatgcttttttagtgtctggtagaggcagtgccaaggggtggctgggagga

SEQ ID NO: 831 - DNA, 3216 bp, Homo sapiens
ggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagaacctcagagtgacagagccaaaagaccagtgcctcattttgctgacatggaaaaggaaacttcgtgggggaaagagatctgcttgcagtcggccagagagacagaaccagggcagtgcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaa

SEQ ID NO: 832 - DNA, 2150 bp, Homo sapiens
ggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgc

SEQ ID NO: 833 - DNA, 2090 bp, Homo sapiens
ctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttaaaaagcatt

SEQ ID NO: 834 - DNA, 707 bp, Homo sapiens
ctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaat

SEQ ID NO: 835 - DNA, 324 bp, Homo sapiens
gacagcatgatgttctggaagccaagagaaaagaggagtttgaggataaatggtcagccatgtcaaatgttgctgagatgctgaggacagcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaa

SEQ ID NO: 836 - DNA, 346 bp, Artificial Sequence
  Synthetic oligonucleotide
ggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccg

SEQ ID NO: 837 - DNA, 135 bp, Artificial Sequence
  Synthetic oligonucleotide
aggaaactaggactgtgtgaattccctgataatgatcagttctccaatcttgaggctctcctcatccagattggaccaaaggaatgtgttttacccggaggagagactgctggagacatggggaaactgagacag

SEQ ID NO: 838 - DNA, 147 bp, Artificial Sequence
  Synthetic oligonucleotide
ataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcag

SEQ ID NO: 839 - DNA, 150 bp, Artificial Sequence
  Synthetic oligonucleotide
gttgcagtttcatcactgtctgcggtaatcaagtttttagaactcttatcagatgattccaactttggacagtttgaactgactacttttgacttcagccagtatatgaaattggatattgcagcagtcagagcccttaacctttttcag

SEQ ID NO: 840 - DNA, 134 bp, Artificial Sequence
  Synthetic oligonucleotide
ggttctgttgaagataccactggctctcagtctctggctgccttgctgaataagtgtaaaacccctcaaggacaaagacttgttaaccagtggattaagcagcctctcatggataagaacagaatagaggagag

SEQ ID NO: 841 - DNA, 200 bp, Artificial Sequence
  Synthetic oligonucleotide
attgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaag

SEQ ID NO: 842 - DNA, 534 bp, Artificial Sequence
  Synthetic oligonucleotide
atcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgc

SEQ ID NO: 843 - DNA, 384 bp, Artificial Sequence
  Synthetic oligonucleotide
ctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcag

SEQ ID NO: 844 - DNA, 124 bp, Artificial Sequence
  Synthetic oligonucleotide
gtggaaaaccatgaattccttgtaaaaccttcatttgatcctaatctcagtgaattaagagaaataatgaatgacttggaaaagaagatgcagtcaacattaataagtgcagccagagatcttg

SEQ ID NO: 845 - DNA, 151 bp, Artificial Sequence
  Synthetic oligonucleotide
gcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacag

SEQ ID NO: 846 - DNA, 246 bp, Artificial Sequence
  Synthetic oligonucleotide
gctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactg

SEQ ID NO: 847 - DNA, 205 bp, Artificial Sequence
  Synthetic oligonucleotide
gccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcag

SEQ ID NO: 848 - DNA, 248 bp, Artificial Sequence
  Synthetic oligonucleotide
gtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaag

SEQ ID NO: 849 - DNA, 176 bp, Artificial Sequence
  Synthetic oligonucleotide
gtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagag

SEQ ID NO: 850 - DNA, 458 bp, Artificial Sequence
  Synthetic oligonucleotide
caaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttaaaaagcatt

SEQ ID NO: 851 - DNA, 234 bp, Artificial Sequence
  Synthetic oligonucleotide
cgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaa

SEQ ID NO: 852 - DNA, 806 bp, Artificial Sequence
  Synthetic oligonucleotide
accctactcccacccgaaacacacagcccctgacacagagctgggcatgtgtgggctctcactagcgctggctgaactgcctgcaccggcagggcatctggcctccttcagcggagagggcccagcaagcaggactccgaccgcctccactactccagctgaattccagcccctgctctcccgtctccaggtcagaacatcagcatttgaacttgagtacttcccccatgcctgtcctgcgggacttggggcttgtactccctctgaggttggaccaccctgaattggggttttccagctagaagaatccctccacagaagcttgaattttccttctgttctctcctttgctctgtacttctcagcaaaaagcatcacctataaatgtgaaggctgattaattctaagtctggggctagtgttaatacagacacagctggcgagatacagaattaaataaacacaaggtcctctgctgactcagcagttggtggaacaggggataagcccttgggcattctagaaagttctgcctgcccagtggtaattttccctttcaggtttcttacctggaaagaaattcccagccactcttgccagcctgtctatttcactaagccagagaacatattttgttgtaagagatttgaacattactttctgctctcaagggacccccctctatcaagtccaattttctgtccctgcctttaccattagagagtctctttggtggagcaaggcagtaccctctctatgcttttttagtgtctggtagaggcagtgccaaggggtggctgggagga

SEQ ID NO: 853 - DNA, 28 bp, Artificial Sequence
  Synthetic oligonucleotide
gggcgacttctatacggcgcacggcgag

SEQ ID NO: 854 - DNA, 20 bp, Artificial Sequence
  Synthetic oligonucleotide
gacgcgctgctggccgcccg

SEQ ID NO: 855 - DNA, 47 bp, Artificial Sequence
  Synthetic oligonucleotide
ggaggtgttcaagacccagggggtgatcaagtacatggggccggcag

SEQ ID NO: 856 - DNA, 53 bp, Artificial Sequence
  Synthetic oligonucleotide
gagcaaagaatctgcagagtgttgtgcttagtaaaatgaattttgaatctttt

SEQ ID NO: 857 - DNA, 53 bp, Artificial Sequence
  Synthetic oligonucleotide
gtaaaagatcttcttctggttcgtcagtatagagttgaagtttataagaatag

SEQ ID NO: 858 - DNA, 40 bp, Artificial Sequence
  Synthetic oligonucleotide
agctggaaataaggcatccaaggagaatgattggtatttg

SEQ ID NO: 859 - DNA, 9 bp, Artificial Sequence
  Synthetic oligonucleotide
gcatataag

SEQ ID NO: 860 - DNA, 10 bp, Artificial Sequence
  Synthetic oligonucleotide
gcttctcctg

SEQ ID NO: 861 - DNA, 79 bp, Artificial Sequence
  Synthetic oligonucleotide
gcaatctctctcagtttgaagacattctctttggtaacaatgatatgtcagcttccattggtgttgtgggtgttaaaat

SEQ ID NO: 862 - DNA, 25 bp, Artificial Sequence
  Synthetic oligonucleotide
gtccgcagttgatggccagagacag

SEQ ID NO: 863 - DNA, 30 bp, Artificial Sequence
  Synthetic oligonucleotide
gttggagttgggtatgtggattccatacag

SEQ ID NO: 864 - DNA, 110 bp, Artificial Sequence
  Synthetic oligonucleotide
gaaaacaccagaaattattgttggcagtttttgtgactcctcttactgatcttcgttctgacttctccaagtttcaggaaatgatagaaacaactttagatatggatcag

SEQ ID NO: 865 - DNA, 48 bp, Artificial Sequence
  Synthetic oligonucleotide
gtttgcaagtcgttattatatttttaaccctttattaattccctaaat

SEQ ID NO: 866 - DNA, 98 bp, Artificial Sequence
  Synthetic oligonucleotide
caaattgacttctttaaatgaagagtataccaaaaataaaacagaatatgaagaagcccaggatgccattgttaaagaaattgtcaatatttcttcag

SEQ ID NO: 867 - DNA, 118 bp, Artificial Sequence
  Synthetic oligonucleotide
aacctcagagtgacagagccaaaagaccagtgcctcattttgctgacatggaaaaggaaacttcgtgggggaaagagatctgcttgcagtcggccagagagacagaaccagggcagtg

SEQ ID NO: 868 - DNA, 90 bp, Artificial Sequence
  Synthetic oligonucleotide
gacagcatgatgttctggaagccaagagaaaagaggagtttgaggataaatggtcagccatgtcaaatgttgctgagatgctgaggacag

SEQ ID NO: 869 - DNA, 3099 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 870 - DNA, 424 bp, Artificial Sequence
  Synthetic oligonucleotide
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggag

SEQ ID NO: 871 - DNA, 168 bp, Artificial Sequence
  Synthetic oligonucleotide
ctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccag

SEQ ID NO: 872 - DNA, 214 bp, Artificial Sequence
  Synthetic oligonucleotide
gtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaa

SEQ ID NO: 873 - DNA, 163 bp, Artificial Sequence
  Synthetic oligonucleotide
gtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgag

SEQ ID NO: 874 - DNA, 129 bp, Artificial Sequence
  Synthetic oligonucleotide
ggggacattcagcagtttttgatcacaggtgatcccaaggcagcatatgactactgtgagcattatagtccagactgtgactcttcagcacccaaggctgctcaagctcaggaacctcagatagatgag

SEQ ID NO: 875 - DNA, 214 bp, Artificial Sequence
  Synthetic oligonucleotide
ccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttg

SEQ ID NO: 876 - DNA, 639 bp, Artificial Sequence
  Synthetic oligonucleotide
atgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 877 - DNA, 117 bp, Artificial Sequence
  Synthetic oligonucleotide
tatgcaccagaggatataatcgaatatgactatgagtatggggaagcagagtataaagaggctgaaagtgtaacagagggacccactgtaactgaggagacaatagcacagacggag

SEQ ID NO: 878 - DNA, 93 bp, Artificial Sequence
  Synthetic oligonucleotide
gcaaacatcgttgatgattttcaagaatacaactatggaacaatggaaagttaccagacagaagctcctaggcatgtttctgggacaaatgag

SEQ ID NO: 879 - DNA, 41 bp, Artificial Sequence
  Synthetic oligonucleotide
gtccaggtgtaccagcagaaactgatattacagaaacaagc

SEQ ID NO: 880 - DNA, 63 bp, Artificial Sequence
  Synthetic oligonucleotide
ataaatggccatggtgcatatggagagaaaggacagaaaggagaaccagcagtggttgagcct

SEQ ID NO: 881 - DNA, 42 bp, Artificial Sequence
  Synthetic oligonucleotide
ggtatgcttgtcgaaggaccaccaggaccagcaggacctgca

SEQ ID NO: 882 - DNA, 63 bp, Artificial Sequence
  Synthetic oligonucleotide
ggtattatgggtcctccaggtctacaaggccccactggaccccctggtgaccctggcgatagg

SEQ ID NO: 883 - DNA, 75 bp, Artificial Sequence
  Synthetic oligonucleotide
ggccccccaggacgtcctggcttaccaggggctgatggtctacctggtcctcctggtactatgttgatgttaccg

SEQ ID NO: 884 - DNA, 84 bp, Artificial Sequence
  Synthetic oligonucleotide
ttccgttatggtggtgatggttccaaaggaccaaccatctctgctcaggaagctcaggctcaagctattcttcagcaggctcgg

SEQ ID NO: 885 - DNA, 57 bp, Artificial Sequence
  Synthetic oligonucleotide
attgctctgagaggcccacctggcccaatgggtctaactggaagaccaggtcctgtg

SEQ ID NO: 886 - DNA, 54 bp, Artificial Sequence
  Synthetic oligonucleotide
ggggggcctggttcatctggggccaaaggtgagagtggtgatccaggtcctcag

SEQ ID NO: 887 - DNA, 54 bp, Artificial Sequence
  Synthetic oligonucleotide
ggccctcgaggcgtccagggtccccctggtccaacgggaaaacctggaaaaagg

SEQ ID NO: 888 - DNA, 54 bp, Artificial Sequence
  Synthetic oligonucleotide
ggtcgtccaggtgcagatggaggaagaggaatgccaggagaacctggggcaaag

SEQ ID NO: 889 - DNA, 54 bp, Artificial Sequence
  Synthetic oligonucleotide
ggagatcgagggtttgatggacttccgggtctgccaggtgacaaaggtcacagg

SEQ ID NO: 890 - DNA, 54 bp, Artificial Sequence
  Synthetic oligonucleotide
ggtgaacgaggtcctcaaggtcctccaggtcctcctggtgatgatggaatgagg

SEQ ID NO: 891 - DNA, 45 bp, Artificial Sequence
  Synthetic oligonucleotide
ggagaagatggagaaattggaccaagaggtcttccaggtgaagct

SEQ ID NO: 892 - DNA, 54 bp, Artificial Sequence
  Synthetic oligonucleotide
ggcccacgaggtttgctgggtccaaggggaactccaggagctccagggcagcct

SEQ ID NO: 893 - DNA, 45 bp, Artificial Sequence
  Synthetic oligonucleotide
ggtatggcaggtgtagatggccccccaggaccaaaagggaacatg

SEQ ID NO: 894 - DNA, 54 bp, Artificial Sequence
  Synthetic oligonucleotide
ggtccccaaggggagcctgggcctccaggtcaacaagggaatccaggacctcag

SEQ ID NO: 895 - DNA, 45 bp, Artificial Sequence
  Synthetic oligonucleotide
ggtcttcctggtccacaaggtccaattggtcctcctggtgaaaaa

SEQ ID NO: 896 - DNA, 3260 bp, Homo sapiens
atatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgagccagtgccatgccctccatggggcacttcagggtccccagaccagaggagcaacactttcctgccagggagacctaggagggagggagaagaggactcagcccagctctgcagagagtgcagatggctgctggtgcccagcaagcagcagggatgggcatcactcccccatgggatctctggagtggccctcactcctgcctagggagaaccataacttttcataaccctgaagcacagatgaggccatcagagaatggagtaggttaactcttccctttgaagcgtcaaagaaaatgccaggagtacacgggctggtaaattacactctggggtctggataagaggaaaaaatattggaaacaaaagaaaggatattttggctagattaagaaaaaaaagacttaaaacgtttatacgttatgtggaaatgttaattaatcctcaaaacaaagaatgaccataacatcaggatgttttagaggagagacttgcacaaatgggaaataagacgggaatcaaatcattgggcaacatttaacatctcttctaactgaggtcctatcagtaataaaaactgtgtaaaatttatcagatgaatactattttataactatgtttgtaattttggctgggaaaagaaggaaaagacatgttgaaactcattaatatgtccaataacttagagagtgagaacacctgaatggtccgtgggacaattcctctagtgagattggtggggtacaaaggagaaggggttgggggagcagagctcagcctgagcctctctacatgcactgtagtagcccagcaccatgggaacctcccggacctgccaggaaaccggataccagacactttttcttccttcccttgcctggaaaatgatcatcttgtctctctttcaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataatacaataaaaact

SEQ ID NO: 897 - DNA, 2848 bp, Homo sapiens
atatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaaggtgagcagggagtgggcagccgctgaggaatccctgtgccatccctgaataccagaggactgcagactttactggggacatcccctgacaggaagctggggtcctctcacaggacatgcactctgcactattagagtagacatttgcagaacttatgcccaagtcaagaaggaaaaagaacccaatgcaggaggaaagctaccatagacaaggacatagtcatctctgcatttagcttcaccctgattgctggcttttagaaattggtacagaacatttctactccctaaagaaactaggcaggcagtggtgccataatgaggatggtctgtgactccagtgtttagtatccaccaaccacataatatcaacttttcctcaagtttcttgaggagaagcctttaggtccacttcatgacatgcatgatacacaagtgaaagtcatcgctcccaggtaagaacccgtagacactgtctctctctccacctctgggctgcagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataatacaataaaaact

SEQ ID NO: 898 - DNA, 2472 bp, Homo sapiens
atatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagtaagcatctccaccatccttctgtttactctgatggggtctgcaaaggggagaagatgtatagggttgggtatctctgtaaatatcggaagtgaagttgatcttatgaccttctgttctgcaggagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataatacaataaaaact

SEQ ID NO: 899 - DNA, 2506 bp, Homo sapiens
atatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggtgagcagatgaagccgggggttcaaattcatttagaaggagagaagtggctttgtgtcctcgctcccctgggagaggagaattggcatggagactagaagatgggtagattggaaaggtgagctcaggtaactccaggttgttggctctttccccaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataatacaataaaaact

SEQ ID NO: 900 - DNA, 3418 bp, Homo sapiens
atatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgagccagtgccatgccctccatggggcacttcagggtccccagaccagaggagcaacactttcctgccagggagacctaggagggagggagaagaggactcagcccagctctgcagagagtgcagatggctgctggtgcccagcaagcagcagggatgggcatcactcccccatgggatctctggagtggccctcactcctgcctagggagaaccataacttttcataaccctgaagcacagatgaggccatcagagaatggagtaggttaactcttccctttgaagcgtcaaagaaaatgccaggagtacacgggctggtaaattacactctggggtctggataagaggaaaaaatattggaaacaaaagaaaggatattttggctagattaagaaaaaaaagacttaaaacgtttatacgttatgtggaaatgttaattaatcctcaaaacaaagaatgaccataacatcaggatgttttagaggagagacttgcacaaatgggaaataagacgggaatcaaatcattgggcaacatttaacatctcttctaactgaggtcctatcagtaataaaaactgtgtaaaatttatcagatgaatactattttataactatgtttgtaattttggctgggaaaagaaggaaaagacatgttgaaactcattaatatgtccaataacttagagagtgagaacacctgaatggtccgtgggacaattcctctagtgagattggtggggtacaaaggagaaggggttgggggagcagagctcagcctgagcctctctacatgcactgtagtagcccagcaccatgggaacctcccggacctgccaggaaaccggataccagacactttttcttccttcccttgcctggaaaatgatcatcttgtctctctttcaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggtgagcagatgaagccgggggttcaaattcatttagaaggagagaagtggctttgtgtcctcgctcccctgggagaggagaattggcatggagactagaagatgggtagattggaaaggtgagctcaggtaactccaggttgttggctctttccccaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataatacaataaaaact

SEQ ID NO: 901 - DNA, 2630 bp, Homo sapiens
atatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggtgagcagatgaagccgggggttcaaattcatttagaaggagagaagtggctttgtgtcctcgctcccctgggagaggagaattggcatggagactagaagatgggtagattggaaaggtgagctcaggtaactccaggttgttggctctttccccaggatgtggatgctgcctacatgaacaaggttgaactgcaagccaaggcagacactctcacagacgagatcaacttcctgagagccttgtatgatgcagtaagcatctccaccatccttctgtttactctgatggggtctgcaaaggggagaagatgtatagggttgggtatctctgtaaatatcggaagtgaagttgatcttatgaccttctgttctgcaggagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataatacaataaaaact

SEQ ID NO: 902 - DNA, 158 bp, Artificial Sequence
  Synthetic oligonucleotide
ctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaag

SEQ ID NO: 903 - DNA, 912 bp, Artificial Sequence
  Synthetic oligonucleotide
gtgagccagtgccatgccctccatggggcacttcagggtccccagaccagaggagcaacactttcctgccagggagacctaggagggagggagaagaggactcagcccagctctgcagagagtgcagatggctgctggtgcccagcaagcagcagggatgggcatcactcccccatgggatctctggagtggccctcactcctgcctagggagaaccataacttttcataaccctgaagcacagatgaggccatcagagaatggagtaggttaactcttccctttgaagcgtcaaagaaaatgccaggagtacacgggctggtaaattacactctggggtctggataagaggaaaaaatattggaaacaaaagaaaggatattttggctagattaagaaaaaaaagacttaaaacgtttatacgttatgtggaaatgttaattaatcctcaaaacaaagaatgaccataacatcaggatgttttagaggagagacttgcacaaatgggaaataagacgggaatcaaatcattgggcaacatttaacatctcttctaactgaggtcctatcagtaataaaaactgtgtaaaatttatcagatgaatactattttataactatgtttgtaattttggctgggaaaagaaggaaaagacatgttgaaactcattaatatgtccaataacttagagagtgagaacacctgaatggtccgtgggacaattcctctagtgagattggtggggtacaaaggagaaggggttgggggagcagagctcagcctgagcctctctacatgcactgtagtagcccagcaccatgggaacctcccggacctgccaggaaaccggataccagacactttttcttccttcccttgcctggaaaatgatcatcttgtctctctttcag

SEQ ID NO: 904 - DNA, 158 bp, Artificial Sequence
  Synthetic oligonucleotide
gtgagcagatgaagccgggggttcaaattcatttagaaggagagaagtggctttgtgtcctcgctcccctgggagaggagaattggcatggagactagaagatgggtagattggaaaggtgagctcaggtaactccaggttgttggctctttccccag

SEQ ID NO: 905 - DNA, 124 bp, Artificial Sequence
  Synthetic oligonucleotide
gtaagcatctccaccatccttctgtttactctgatggggtctgcaaaggggagaagatgtatagggttgggtatctctgtaaatatcggaagtgaagttgatcttatgaccttctgttctgcag

SEQ ID NO: 906 - DNA, 121 bp, Artificial Sequence
  Synthetic oligonucleotide
gagctgtcccagatgcagacccacatctcagacacatctgtggtgctgtccatggacaacaaccgcaacctggacctggacagcatcatcgctgaggtcaaggcccaatatgaggagattg

SEQ ID NO: 907 - DNA, 500 bp, Artificial Sequence
  Synthetic oligonucleotide
gtgagcagggagtgggcagccgctgaggaatccctgtgccatccctgaataccagaggactgcagactttactggggacatcccctgacaggaagctggggtcctctcacaggacatgcactctgcactattagagtagacatttgcagaacttatgcccaagtcaagaaggaaaaagaacccaatgcaggaggaaagctaccatagacaaggacatagtcatctctgcatttagcttcaccctgattgctggcttttagaaattggtacagaacatttctactccctaaagaaactaggcaggcagtggtgccataatgaggatggtctgtgactccagtgtttagtatccaccaaccacataatatcaacttttcctcaagtttcttgaggagaagcctttaggtccacttcatgacatgcatgatacacaagtgaaagtcatcgctcccaggtaagaacccgtagacactgtctctctctccacctctgggctgcag

SEQ ID NO: 908 - DNA, 128 bp, Artificial Sequence
  Synthetic oligonucleotide
ctcaaggatgccaagaacaagctggaagggctggaggatgccctgcagaaggccaagcaggacctggcccggctgctgaaggagtaccaggagctgatgaatgtcaagctggccctggacgtggagat

SEQ ID NO: 909 - DNA, 211 bp, Artificial Sequence
  Synthetic oligonucleotide
atcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataa

SEQ ID NO: 910 - DNA, 93 bp, Artificial Sequence
  Synthetic oligonucleotide
atatataagctgctgccccgagcctgattcctagtcctgcttctcttccctctctcctccagcctctcacactctcctcagctctctcatctc

SEQ ID NO: 911 - DNA, 28 bp, Artificial Sequence
  Synthetic oligonucleotide
ctggaaccatggccagcacatccaccac

SEQ ID NO: 912 - DNA, 15 bp, Artificial Sequence
  Synthetic oligonucleotide
catcaggagccacag

SEQ ID NO: 913 - DNA, 32 bp, Artificial Sequence
  Synthetic oligonucleotide
cagcagccgccggggtttcagtgccaactcag

SEQ ID NO: 914 - DNA, 34 bp, Artificial Sequence
  Synthetic oligonucleotide
ccaggctccctggggtcagccgctctggcttcag

SEQ ID NO: 915 - DNA, 72 bp, Artificial Sequence
  Synthetic oligonucleotide
cagcgtctccgtgtcccgctccaggggcagtggtggcctgggtggtgcatgtggaggagctggctttggcag

SEQ ID NO: 916 - DNA, 24 bp, Artificial Sequence
  Synthetic oligonucleotide
ccgcagtctgtatggcctgggggg

SEQ ID NO: 917 - DNA, 30 bp, Artificial Sequence
  Synthetic oligonucleotide
ctccaagaggatctccattggagggggcag

SEQ ID NO: 918 - DNA, 42 bp, Artificial Sequence
  Synthetic oligonucleotide
ctgtgccatcagtggcggctatggcagcagagccggaggcag

SEQ ID NO: 919 - DNA, 11 bp, Artificial Sequence
  Synthetic oligonucleotide
ctatggctttg

SEQ ID NO: 920 - DNA, 30 bp, Artificial Sequence
  Synthetic oligonucleotide
gtggcgccgggagtggatttggtttcggtg

SEQ ID NO: 921 - DNA, 72 bp, Artificial Sequence
  Synthetic oligonucleotide
gtggagccggcattggctttggtctgggtggtggagccggccttgctggtggctttgggggccctggcttcc

SEQ ID NO: 922 - DNA, 60 bp, Artificial Sequence
  Synthetic oligonucleotide
gtgcggttcctggagcagcagaacaaggttctggaaacaaagtggaccctgctgcaggag

SEQ ID NO: 923 - DNA, 60 bp, Artificial Sequence
  Synthetic oligonucleotide
cagggcaccaagactgtgaggcagaacctggagccgttgttcgagcagtacatcaacaac

SEQ ID NO: 924 - DNA, 54 bp, Artificial Sequence
  Synthetic oligonucleotide
ctcaggaggcagctggacagcattgtcggggaacggggccgcctggactcagag

SEQ ID NO: 925 - DNA, 7 bp, Artificial Sequence
  Synthetic oligonucleotide
ctcagag

SEQ ID NO: 926 - DNA, 5 bp, Artificial Sequence
  Synthetic oligonucleotide
gcatg

SEQ ID NO: 927 - DNA, 29 bp, Artificial Sequence
  Synthetic oligonucleotide
caggacctggtggaggacttcaagaacaa

SEQ ID NO: 928 - DNA, 22 bp, Artificial Sequence
  Synthetic oligonucleotide
atatgaggatgaaatcaacaag

SEQ ID NO: 929 - DNA, 39 bp, Artificial Sequence
  Synthetic oligonucleotide
cgcacagcagcagagaatgaatttgtgactctgaagaag

SEQ ID NO: 930 - DNA, 96 bp, Artificial Sequence
  Synthetic oligonucleotide
gatgtggatgctgcctacatgaacaaggttgaactgcaagccaaggcagacactctcacagacgagatcaacttcctgagagccttgtatgatgca

SEQ ID NO: 931 - DNA, 20 bp, Artificial Sequence
  Synthetic oligonucleotide
ctcagagaagccgggctgag

SEQ ID NO: 932 - DNA, 24 bp, Artificial Sequence
  Synthetic oligonucleotide
gctgagtcctggtaccagaccaag

SEQ ID NO: 933 - DNA, 53 bp, Artificial Sequence
  Synthetic oligonucleotide
tacgaggagctgcaggtcacagcaggcagacatggggacgacctgcgcaacac

SEQ ID NO: 934 - DNA, 47 bp, Artificial Sequence
  Synthetic oligonucleotide
caagcaggagattgctgagatcaaccgcatgatccagaggctgagat

SEQ ID NO: 935 - DNA, 26 bp, Artificial Sequence
  Synthetic oligonucleotide
ctgagatcgaccacgtcaagaagcag

SEQ ID NO: 936 - DNA, 20 bp, Artificial Sequence
  Synthetic oligonucleotide
tgcgccaacctgcaggccgc

SEQ ID NO: 937 - DNA, 34 bp, Artificial Sequence
  Synthetic oligonucleotide
cattgctgatgctgagcagcgtggggagatggcc

SEQ ID NO: 938 - DNA, 16 bp, Artificial Sequence
  Synthetic oligonucleotide
cgccacctaccgcaag

SEQ ID NO: 939 - DNA, 23 bp, Artificial Sequence
  Synthetic oligonucleotide
ctgctggagggtgaggagtgcag

SEQ ID NO: 940 - DNA, 25 bp, Artificial Sequence
  Synthetic oligonucleotide
gctgaatggcgaaggcgttggacaa

SEQ ID NO: 941 - DNA, 10 bp, Artificial Sequence
  Synthetic oligonucleotide
gtcaacatct

SEQ ID NO: 942 - DNA, 47 bp, Artificial Sequence
  Synthetic oligonucleotide
ctgtggtgcagtccaccgtctccagtggctatggcggtgccagtggt

SEQ ID NO: 943 - DNA, 7 bp, Artificial Sequence
  Synthetic oligonucleotide
gtcggca

SEQ ID NO: 944 - DNA, 11 bp, Artificial Sequence
  Synthetic oligonucleotide
gtggcttaggc

SEQ ID NO: 945 - DNA, 17 bp, Artificial Sequence
  Synthetic oligonucleotide
ctgggtggaggaagcag

SEQ ID NO: 946 - DNA, 29 bp, Artificial Sequence
  Synthetic oligonucleotide
ctactcctatggcagtggtcttggcgttg

SEQ ID NO: 947 - DNA, 22 bp, Artificial Sequence
  Synthetic oligonucleotide
gaggtggcttcagttccagcag

SEQ ID NO: 948 - DNA, 38 bp, Artificial Sequence
  Synthetic oligonucleotide
tggcagagccattgggggtggcctcagctctgttggag

SEQ ID NO: 949 - DNA, 7 bp, Artificial Sequence
  Synthetic oligonucleotide
gcggcag

SEQ ID NO: 950 - DNA, 12 bp, Artificial Sequence
  Synthetic oligonucleotide
ttccaccatcaa

SEQ ID NO: 951 - DNA, 24 bp, Artificial Sequence
  Synthetic oligonucleotide
gtacaccaccacctcctcctccag

SEQ ID NO: 952 - DNA, 62 bp, Artificial Sequence
  Synthetic oligonucleotide
caggaagagctataagcactaaagtgcgtctgctagctctcggtcccacagtcctcaggccc

SEQ ID NO: 953 - DNA, 8 bp, Artificial Sequence
  Synthetic oligonucleotide
ctctctgg

SEQ ID NO: 954 - DNA, 6 bp, Artificial Sequence
  Synthetic oligonucleotide
ctgcag

SEQ ID NO: 955 - DNA, 14 bp, Artificial Sequence
  Synthetic oligonucleotide
agccctctcctcag

SEQ ID NO: 956 - DNA, 31 bp, Artificial Sequence
  Synthetic oligonucleotide
gttgcctttcctctcctggcctccagtctcc

SEQ ID NO: 957 - DNA, 37 bp, Artificial Sequence
  Synthetic oligonucleotide
cctgctgtcccaggtagagctgggtatgaatgcttag

SEQ ID NO: 958 - DNA, 52 bp, Artificial Sequence
  Synthetic oligonucleotide
tgccctcacttcttctctctctctctataccatctgagcacccattgctcac

SEQ ID NO: 959 - DNA, 6 bp, Artificial Sequence
  Synthetic oligonucleotide
catcag

SEQ ID NO: 960 - DNA, 37 bp, Artificial Sequence
  Synthetic oligonucleotide
gtgttgtgaacccccacccaggcagtatccatgaaag

SEQ ID NO: 961 - DNA, 110 bp, Artificial Sequence
  Synthetic oligonucleotide
cacaagtgactagtcctatgatgtacaaagcctgtatctctgtgatgatttctgtgctcttcactctttgcaattgctaaataaagcagatttataatacaataaaaact

SEQ ID NO: 962 - DNA, 2248 bp, Homo sapiens
gcagagcaagtcccgctgcttggaacagggtggttcgccgttataacaggccgtcagactctcaacatgttcctgatgagattagaagctcctgcaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 963 - DNA, 2672 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggtaagaaacttatctaaatttttcacatgggtgggttttttttcctcaagttgtcatatcacaatgagtgaaagatttgaatggaactgacattaaataacacaacacagaaccagatgaccgactccaaatctccctgcaggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 964 - DNA, 2571 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaacctctgaaagctcaaaaaagaacactagagaaattgactaggtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 965 - DNA, 2887 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaaggtgggtgctctgatgactgtctcctgagtgaggggacacacccatgtctaggattctaggccatgacgacactaagaatggggctcctggaacctgctgaagcccattgggatgctttataggaatggctgtgtagacaatttccatctaaacccaaggacctgagaaataatctcactctgaatctcacaccagtgtctccaggagagcaaaggcactagactagctcagccttggaaaagcctgaaccagccccacactatttgccaccacttagtactcactgcctgtgaactttgggaaagttcttcccattctcatataaacagaatctttcctctttcctggctgcatcagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 966 - DNA, 3334 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcaggtgagtagacagcatgaactcaagatggccttcagctgataaagcgaagctgctctactgtggggtgtacaacacacatacatgagatcagtgacttgtgcgtgataatgacacatcatcaacactatttcagtctgactcatggccatatagctgacctcaactcacttttctggtctcttttcccccaccggtgttcctgggcactggctgtcctccaagcacctgagcaactcagcaatcttcttgacacttgtgccttttctgcttttgctcacgtcctttgctcaacctcaatatccatgtcatgcccacctccatccacccttgtcctccagtaccccttccttcaggaaggctttcatgtttactccagctgagttaaactcagctacctttggattgtcaaactactgtttgcttcaacctctgacattgcccattgcctactttctgttggaggaatttctgtccgtgccaagttctctcacagaatgtaactcctacaaggcaaaaactgctttcgacataatcacattttccaaatctcttatactttccccatagtgggtggagaagaatgtgaattataattctttcctaacaacttgtttctaggtcaatccctcttcattggaaaatccctctggagagttctcccttcctttaacttaagcagcttttgggtgtacagactcctggcttatggaatgaactcgaatcatgaggatgggagttagccacatagactaatgctgtctttttgggagctgttaacccttaattcaatttttcccctttcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 967 - DNA, 3891 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcaggtgagtagacagcatgaactcaagatggccttcagctgataaagcgaagctgctctactgtggggtgtacaacacacatacatgagatcagtgacttgtgcgtgataatgacacatcatcaacactatttcagtctgactcatggccatatagctgacctcaactcacttttctggtctcttttcccccaccggtgttcctgggcactggctgtcctccaagcacctgagcaactcagcaatcttcttgacacttgtgccttttctgcttttgctcacgtcctttgctcaacctcaatatccatgtcatgcccacctccatccacccttgtcctccagtaccccttccttcaggaaggctttcatgtttactccagctgagttaaactcagctacctttggattgtcaaactactgtttgcttcaacctctgacattgcccattgcctactttctgttggaggaatttctgtccgtgccaagttctctcacagaatgtaactcctacaaggcaaaaactgctttcgacataatcacattttccaaatctcttatactttccccatagtgggtggagaagaatgtgaattataattctttcctaacaacttgtttctaggtcaatccctcttcattggaaaatccctctggagagttctcccttcctttaacttaagcagcttttgggtgtacagactcctggcttatggaatgaactcgaatcatgaggatgggagttagccacatagactaatgctgtctttttgggagctgttaacccttaattcaatttttcccctttcagactcagtggagaaggagttggaccagtcaacatctgtaagtagctttgaacagacattaacaacgacaataatatgggatatatttagtgccaactcagaattctgctgtttctagatccaaacttttcccatcccagcatatggttatttataataatacacttagtaagttgtgggtggtggaggggaaggacagattgggacaggaagcaatgtggcttatgtctcatctcttaaagggtaagccatgcatcctatgcttcttggaccctgtcccctgccttgtccctagtacctagctccccccagtacctagctcctcccctcagtacctagctcccctcagtacctagctccctgtagtacctagctcccctcagtacctagctcctctcagtacctagcaccttgcctcttacactcacccacttttttagggaccttaattaaatgacagttcttccgggccttgtttgctactctgtaaagggggtccagtagagtgctccaacaccagcagatcaaataaatgggccatgcaggatcagcctggcagatggtctcactgagtcctccctcctttccctgcagctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 968 - DNA, 1735 bp, Homo sapiens
gcagagcaagtcccgctgcttggaacagggtggttcgccgttataacaggccgtcagactctcaacatgttcctgatgagattagaagctcctgcaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 969 - DNA, 2779 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacaggtagggtgagattgaaagagggcaaggaaggggcctgagttctaaaagaaacacctactttgttttattttgttttacttttgctaaacacacgcagctagatccagtaccagtgtttcagtgtcctgccacccacgatgtactggtttctctctgggattcatgatagtttggtttgtctgacccagaaactcagaaggagacacctcaggtcccaagcaaccccactctcctcctttctatctgtagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 970 - DNA, 1778 bp, Homo sapiens
tttgtttctgtgccctggatttgtggacacgttctgaattagactggcagctgggaagggagaattatttcttcccattcagaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggtgcgtgtgggtgggagagaaccagcagcctgcagctatgctctctaagcgtggagctcacttgagtagggtgacggtgtgtgcagtgccaatcatccctgtttccccaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 971 - DNA, 3029 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggtaagaaacttatctaaatttttcacatgggtgggttttttttcctcaagttgtcatatcacaatgagtgaaagatttgaatggaactgacattaaataacacaacacagaaccagatgaccgactccaaatctccctgcaggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaaggtgggtgctctgatgactgtctcctgagtgaggggacacacccatgtctaggattctaggccatgacgacactaagaatggggctcctggaacctgctgaagcccattgggatgctttataggaatggctgtgtagacaatttccatctaaacccaaggacctgagaaataatctcactctgaatctcacaccagtgtctccaggagagcaaaggcactagactagctcagccttggaaaagcctgaaccagccccacactatttgccaccacttagtactcactgcctgtgaactttgggaaagttcttcccattctcatataaacagaatctttcctctttcctggctgcatcagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 972 - DNA, 3136 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaaggtgggtgctctgatgactgtctcctgagtgaggggacacacccatgtctaggattctaggccatgacgacactaagaatggggctcctggaacctgctgaagcccattgggatgctttataggaatggctgtgtagacaatttccatctaaacccaaggacctgagaaataatctcactctgaatctcacaccagtgtctccaggagagcaaaggcactagactagctcagccttggaaaagcctgaaccagccccacactatttgccaccacttagtactcactgcctgtgaactttgggaaagttcttcccattctcatataaacagaatctttcctctttcctggctgcatcagtatgaggagctgcagcagacagctggccggcatggcgatgacctccgcaacaccaagcatgagatctctgagatgaaccggatgatccagaggctgagagccgagattgacaatgtcaagaaacaggtagggtgagattgaaagagggcaaggaaggggcctgagttctaaaagaaacacctactttgttttattttgttttacttttgctaaacacacgcagctagatccagtaccagtgtttcagtgtcctgccacccacgatgtactggtttctctctgggattcatgatagtttggtttgtctgacccagaaactcagaaggagacacctcaggtcccaagcaaccccactctcctcctttctatctgtagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 973 - DNA, 3583 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacaggtagggtgagattgaaagagggcaaggaaggggcctgagttctaaaagaaacacctactttgttttattttgttttacttttgctaaacacacgcagctagatccagtaccagtgtttcagtgtcctgccacccacgatgtactggtttctctctgggattcatgatagtttggtttgtctgacccagaaactcagaaggagacacctcaggtcccaagcaaccccactctcctcctttctatctgtagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcaggtgagtagacagcatgaactcaagatggccttcagctgataaagcgaagctgctctactgtggggtgtacaacacacatacatgagatcagtgacttgtgcgtgataatgacacatcatcaacactatttcagtctgactcatggccatatagctgacctcaactcacttttctggtctcttttcccccaccggtgttcctgggcactggctgtcctccaagcacctgagcaactcagcaatcttcttgacacttgtgccttttctgcttttgctcacgtcctttgctcaacctcaatatccatgtcatgcccacctccatccacccttgtcctccagtaccccttccttcaggaaggctttcatgtttactccagctgagttaaactcagctacctttggattgtcaaactactgtttgcttcaacctctgacattgcccattgcctactttctgttggaggaatttctgtccgtgccaagttctctcacagaatgtaactcctacaaggcaaaaactgctttcgacataatcacattttccaaatctcttatactttccccatagtgggtggagaagaatgtgaattataattctttcctaacaacttgtttctaggtcaatccctcttcattggaaaatccctctggagagttctcccttcctttaacttaagcagcttttgggtgtacagactcctggcttatggaatgaactcgaatcatgaggatgggagttagccacatagactaatgctgtctttttgggagctgttaacccttaattcaatttttcccctttcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatata

SEQ ID NO: 974 - DNA, 838 bp, Homo sapiens
gcagagcaagtcccgctgcttggaacagggtggttcgccgttataacaggccgtcagactctcaacatgttcctgatgagattagaagctcctgcaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcatcgtgggggaacggggccgcctggactcagag

SEQ ID NO: 975 - DNA, 379 bp, Artificial Sequence
  Synthetic oligonucleotide
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccag

SEQ ID NO: 976 - DNA, 133 bp, Artificial Sequence
  Synthetic oligonucleotide
gtgtgtccttccggagcgggggcagtcgtagcttcagcaccgcctctgccatcaccccgtctgtctcccgcaccagcttcacctccgtgtcccggtccgggggtggcggtggtggtggcttcggcagggtcag

SEQ ID NO: 977 - DNA, 142 bp, Artificial Sequence
  Synthetic oligonucleotide
gtaagaaacttatctaaatttttcacatgggtgggttttttttcctcaagttgtcatatcacaatgagtgaaagatttgaatggaactgacattaaataacacaacacagaaccagatgaccgactccaaatctccctgcag

SEQ ID NO: 978 - DNA, 161 bp, Artificial Sequence
  Synthetic oligonucleotide
gagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagac

SEQ ID NO: 979 - DNA, 348 bp, Artificial Sequence
  Synthetic oligonucleotide
gtgggtgctctgatgactgtctcctgagtgaggggacacacccatgtctaggattctaggccatgacgacactaagaatggggctcctggaacctgctgaagcccattgggatgctttataggaatggctgtgtagacaatttccatctaaacccaaggacctgagaaataatctcactctgaatctcacaccagtgtctccaggagagcaaaggcactagactagctcagccttggaaaagcctgaaccagccccacactatttgccaccacttagtactcactgcctgtgaactttgggaaagttcttcccattctcatataaacagaatctttcctctttcctgg

SEQ ID NO: 980 - DNA, 249 bp, Artificial Sequence
  Synthetic oligonucleotide
gtagggtgagattgaaagagggcaaggaaggggcctgagttctaaaagaaacacctactttgttttattttgttttacttttgctaaacacacgcagctagatccagtaccagtgtttcagtgtcctgccacccacgatgtactggtttctctctgggattcatgatagtttggtttgtctgacccagaaactcagaaggagacacctcaggtcccaagcaaccccactctcctcctttctatctgtag

SEQ ID NO: 981 - DNA, 804 bp, Artificial Sequence
  Synthetic oligonucleotide
gtgagtagacagcatgaactcaagatggccttcagctgataaagcgaagctgctctactgtggggtgtacaacacacatacatgagatcagtgacttgtgcgtgataatgacacatcatcaacactatttcagtctgactcatggccatatagctgacctcaactcacttttctggtctcttttcccccaccggtgttcctgggcactggctgtcctccaagcacctgagcaactcagcaatcttcttgacacttgtgccttttctgcttttgctcacgtcctttgctcaacctcaatatccatgtcatgcccacctccatccacccttgtcctccagtaccccttccttcaggaaggctttcatgtttactccagctgagttaaactcagctacctttggattgtcaaactactgtttgcttcaacctctgacattgcccattgcctactttctgttggaggaatttctgtccgtgccaagttctctcacagaatgtaactcctacaaggcaaaaactgctttcgacataatcacattttccaaatctcttatactttccccatagtgggtggagaagaatgtgaattataattctttcctaacaacttgtttctaggtcaatccctcttcattggaaaatccctctggagagttctcccttcctttaacttaagcagcttttgggtgtacagactcctggcttatggaatgaactcgaatcatgaggatgggagttagccacatagactaatgctgtctttttgggagctgttaacccttaattcaatttttcccctttcag

SEQ ID NO: 982 - DNA, 557 bp, Artificial Sequence
  Synthetic oligonucleotide
gtaagtagctttgaacagacattaacaacgacaataatatgggatatatttagtgccaactcagaattctgctgtttctagatccaaacttttcccatcccagcatatggttatttataataatacacttagtaagttgtgggtggtggaggggaaggacagattgggacaggaagcaatgtggcttatgtctcatctcttaaagggtaagccatgcatcctatgcttcttggaccctgtcccctgccttgtccctagtacctagctccccccagtacctagctcctcccctcagtacctagctcccctcagtacctagctccctgtagtacctagctcccctcagtacctagctcctctcagtacctagcaccttgcctcttacactcacccacttttttagggaccttaattaaatgacagttcttccgggccttgtttgctactctgtaaagggggtccagtagagtgctccaacaccagcagatcaaataaatgggccatgcaggatcagcctggcagatggtctcactgagtcctccctcctttccctgcag

SEQ ID NO: 983 - DNA, 243 bp, Artificial Sequence
  Synthetic oligonucleotide
ccaaagttttcccaaatctaaatcatcaaaacagaatccccaccccaatcccaaattttgttttggttctaactacctccagaatgtgttcaataaaatgcttttataatataagctggtgtgcagaattgttttttttttctaggtttacaatcagcctagagataccatgagggtcagtctacccagatgtgattggttcttttgatgattcacagggagaatgggataacatttaaggga

SEQ ID NO: 984 - DNA, 174 bp, Artificial Sequence
  Synthetic oligonucleotide
gtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcatcgtgggggaacggggccgcctggactcagag

SEQ ID NO: 985 - DNA, 97 bp, Artificial Sequence
  Synthetic oligonucleotide
gcagagcaagtcccgctgcttggaacagggtggttcgccgttataacaggccgtcagactctcaacatgttcctgatgagattagaagctcctgcag

SEQ ID NO: 986 - DNA, 23 bp, Artificial Sequence
  Synthetic oligonucleotide
gaacaagccaccatgtctcgcca

SEQ ID NO: 987 - DNA, 5 bp, Artificial Sequence
  Synthetic oligonucleotide
gtcaa

SEQ ID NO: 988 - DNA, 36 bp, Artificial Sequence
  Synthetic oligonucleotide
ccttgcgggtgcttgtggagtgggtggctatggcag

SEQ ID NO: 989 - DNA, 24 bp, Artificial Sequence
  Synthetic oligonucleotide
ccggagcctctacaacctgggggg

SEQ ID NO: 990 - DNA, 48 bp, Artificial Sequence
  Synthetic oligonucleotide
ctccaagaggatatccatcagcactagtggtggcagcttcaggaaccg

SEQ ID NO: 991 - DNA, 20 bp, Artificial Sequence
  Synthetic oligonucleotide
gtttggtgctggtgctggag

SEQ ID NO: 992 - DNA, 48 bp, Artificial Sequence
  Synthetic oligonucleotide
gcggctatggctttggaggtggtgccggtagtggatttggtttcggcg

SEQ ID NO: 993 - DNA, 101 bp, Artificial Sequence
  Synthetic oligonucleotide
gtggagctggtggtggctttgggctcggtggcggagctggctttggaggtggcttcggtggccctggctttcctgtctgccctcctggaggtatccaagag

SEQ ID NO: 994 - DNA, 96 bp, Artificial Sequence
  Synthetic oligonucleotide
gtcactgtcaaccagagtctcctgactcccctcaacctgcaaatcgaccccagcatccagagggtgaggaccgaggagcgcgagcagatcaagacc

SEQ ID NO: 995 - DNA, 12 bp, Artificial Sequence
  Synthetic oligonucleotide
ctcaacaataag

SEQ ID NO: 996 - DNA, 21 bp, Artificial Sequence
  Synthetic oligonucleotide
tttgcctccttcatcgacaag

SEQ ID NO: 997 - DNA, 84 bp, Artificial Sequence
  Synthetic oligonucleotide
tttgtttctgtgccctggatttgtggacacgttctgaattagactggcagctgggaagggagaattatttcttcccattcagag

SEQ ID NO: 998 - DNA, 87 bp, Artificial Sequence
  Synthetic oligonucleotide
gtgcggttcctggagcagcagaacaaggttctggacaccaagtggaccctgctgcaggagcagggcaccaagactgtgaggcagaac

SEQ ID NO: 999 - DNA, 116 bp, Artificial Sequence
  Synthetic oligonucleotide
ctggagccgttgttcgagcagtacatcaacaacctcaggaggcagctggacagcatcgtgggggaacggggccgcctggactcagagctgagaaacatgcaggacctggtggaaga

SEQ ID NO: 1000 - DNA, 12 bp, Artificial Sequence
  Synthetic oligonucleotide
cttcaagaacaa

SEQ ID NO: 1001 - DNA, 41 bp, Artificial Sequence
  Synthetic oligonucleotide
cctctgaaagctcaaaaaagaacactagagaaattgactag

SEQ ID NO: 1002 - DNA, 52 bp, Artificial Sequence
  Synthetic oligonucleotide
gtatgaggatgaaatcaacaagcgtaccactgctgagaatgagtttgtgatg

SEQ ID NO: 1003 - DNA, 9 bp, Artificial Sequence
  Synthetic oligonucleotide
ctgaagaag

SEQ ID NO: 1004 - DNA, 110 bp, Artificial Sequence
  Synthetic oligonucleotide
gtgcgtgtgggtgggagagaaccagcagcctgcagctatgctctctaagcgtggagctcacttgagtagggtgacggtgtgtgcagtgccaatcatccctgtttccccag

SEQ ID NO: 1005 - DNA, 27 bp, Artificial Sequence
  Synthetic oligonucleotide
gatgtagatgctgcctacatgaacaag

SEQ ID NO: 1006 - DNA, 6 bp, Artificial Sequence
  Synthetic oligonucleotide
gtggag

SEQ ID NO: 1007 - DNA, 27 bp, Artificial Sequence
  Synthetic oligonucleotide
ctggaggccaaggttgatgcactgatg

SEQ ID NO: 1008 - DNA, 36 bp, Artificial Sequence
  Synthetic oligonucleotide
gatgagattaacttcatgaagatgttctttgatgcg

SEQ ID NO: 1009 - DNA, 4 bp, Artificial Sequence
  Synthetic oligonucleotide
caag

SEQ ID NO: 1010 - DNA, 9 bp, Artificial Sequence
  Synthetic oligonucleotide
ctgcatcag

SEQ ID NO: 1011 - DNA, 22 bp, Artificial Sequence
  Synthetic oligonucleotide
tatgaggagctgcagcagacag

SEQ ID NO: 1012 - DNA, 20 bp, Artificial Sequence
  Synthetic oligonucleotide
ctggccggcatggcgatgac

SEQ ID NO: 1013 - DNA, 37 bp, Artificial Sequence
  Synthetic oligonucleotide
ctccgcaacaccaagcatgagatctctgagatgaacc

SEQ ID NO: 1014 - DNA, 47 bp, Artificial Sequence
  Synthetic oligonucleotide
ggatgatccagaggctgagagccgagattgacaatgtcaagaaacag

SEQ ID NO: 1015 - DNA, 75 bp, Artificial Sequence
  Synthetic oligonucleotide
tgcgccaatctgcagaacgccattgcggatgccgagcagcgtggggagctggccctcaaggatgccaggaacaag

SEQ ID NO: 1016 - DNA, 54 bp, Artificial Sequence
  Synthetic oligonucleotide
ctggccgagctggaggaggccctgcagaaggccaagcaggacatggcccggctg

SEQ ID NO: 1017 - DNA, 88 bp, Artificial Sequence
  Synthetic oligonucleotide
ctgcgtgagtaccaggagctcatgaacaccaagctggccctggacgtggagatcgccacttaccgcaagctgctggagggcgaggaat

SEQ ID NO: 1018 - DNA, 4 bp, Artificial Sequence
  Synthetic oligonucleotide
gcag

SEQ ID NO: 1019 - DNA, 35 bp, Artificial Sequence
  Synthetic oligonucleotide
actcagtggagaaggagttggaccagtcaacatct

SEQ ID NO: 1020 - DNA, 40 bp, Artificial Sequence
  Synthetic oligonucleotide
ctgttgtcacaagcagtgtttcctctggatatggcagtgg

SEQ ID NO: 1021 - DNA, 42 bp, Artificial Sequence
  Synthetic oligonucleotide
cagtggctatggcggtggcctcggtggaggtcttggcggcgg

SEQ ID NO: 1022 - DNA, 11 bp, Artificial Sequence
  Synthetic oligonucleotide
cctcggtggag

SEQ ID NO: 1023 - DNA, 12 bp, Artificial Sequence
  Synthetic oligonucleotide
gtcttgccggag

SEQ ID NO: 1024 - DNA, 6 bp, Artificial Sequence
  Synthetic oligonucleotide
gtagca

SEQ ID NO: 1025 - DNA, 7 bp, Artificial Sequence
  Synthetic oligonucleotide
gtggaag

SEQ ID NO: 1026 - DNA, 4 bp, Artificial Sequence
  Synthetic oligonucleotide
ctac

SEQ ID NO: 1027 - DNA, 11 bp, Artificial Sequence
  Synthetic oligonucleotide
tactccagcag

SEQ ID NO: 1028 - DNA, 23 bp, Artificial Sequence
  Synthetic oligonucleotide
cagtgggggtgtcggcctaggtg

SEQ ID NO: 1029 - DNA, 40 bp, Artificial Sequence
  Synthetic oligonucleotide
gtgggctcagtgtggggggctctggcttcagtgcaagcag

SEQ ID NO: 1030 - DNA, 8 bp, Artificial Sequence
  Synthetic oligonucleotide
tggccgag

SEQ ID NO: 1031 - DNA, 8 bp, Artificial Sequence
  Synthetic oligonucleotide
ggctgggg

SEQ ID NO: 1032 - DNA, 23 bp, Artificial Sequence
  Synthetic oligonucleotide
gtgggctttggcagtggcggggg

SEQ ID NO: 1033 - DNA, 49 bp, Artificial Sequence
  Synthetic oligonucleotide
tagcagctccagcgtcaaatttgtctccaccacctcctcctcccggaag

SEQ ID NO: 1034 - DNA, 19 bp, Artificial Sequence
  Synthetic oligonucleotide
agcttcaagagctaagaac

SEQ ID NO: 1035 - DNA, 17 bp, Artificial Sequence
  Synthetic oligonucleotide
ctgctgcaagtcactgc

SEQ ID NO: 1036 - DNA, 37 bp, Artificial Sequence
  Synthetic oligonucleotide
cttccaagtgcagcaacccagcccatggagattgcct

SEQ ID NO: 1037 - DNA, 59 bp, Artificial Sequence
  Synthetic oligonucleotide
cttctaggcagttgctcaagccatgttttatccttttctggagagtagtctagaccaag

SEQ ID NO: 1038 - DNA, 13 bp, Artificial Sequence
  Synthetic oligonucleotide
ccaattgcagaac

SEQ ID NO: 1039 - DNA, 19 bp, Artificial Sequence
  Synthetic oligonucleotide
cacattctttggttcccag

SEQ ID NO: 1040 - DNA, 62 bp, Artificial Sequence
  Synthetic oligonucleotide
gagagccccattcccagcccctggtctcccgtgccgcagttctatattctgcttcaaatcag

SEQ ID NO: 1041 - DNA, 36 bp, Artificial Sequence
  Synthetic oligonucleotide
ccttcaggtttcccacagcatggcccctgctgacac

SEQ ID NO: 1042 - DNA, 6 bp, Artificial Sequence
  Synthetic oligonucleotide
gagaac

SEQ ID NO: 1043 - DNA, 3897 bp, Homo sapiens
aaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcagccacccacctgcccactcatcacagttttggagactgctcgcctacgtccatcccctcaggttggcctcctctctctgggctgtcattaactcaagcacacaccaccagagcagctggtggggttttgccatcccctctttaccttattgtgttaacataggtttctttctctccccatctgccacaagcagcagcagaaacgaccgaatccagagctccgccggaacatgaccatcaaaaccgaactccccctgggcgcacgttagtatgggagagtgggccttgggcctggtccttgttctggggccatatctttagggaaccagactctgggattctgttcccacctcaaagggatctgagcccagagaaggagagcaaagctcctggggctgagaaggggtgtactccagtccccctgctcctgatctctcgtgtttcctcctagggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgc

SEQ ID NO: 1044 - DNA, 2926 bp, Homo sapiens
gaagggtccctatggccatgttttgtctaggtgccagccctagacacagaacaccctgagggtcaggcacacacccacttccctccccttccatgggcatcacaagggcacactgagcagagcagggcacagcaggggagcatgctgcagcagccacaagcgcatggcaccagcctcaggggcggcagttcgttcgctcacttttgtgcctagcttttctttgccacgcatatagctacctgctctggcatcccccaggggtgttgaggacacgtgggtgaagcggtagtgccactctgccatcatgtgtctgtaggccacccacctgcccactcatcacagttttggagactgctcgcctacgtccatcccctcaggttggcctcctctctctgggctgtcattaactcaagcacacaccaccagagcagctggtggggttttgccatcccctctttaccttattgtgttaacataggtttctttctctccccatctgccacaagcagcagcagaaacgaccgaatccagagctccgccggaacatgaccatcaaaaccgaactccccctgggcgcacgttagtatgggagagtgggccttgggcctggtccttgttctggggccatatctttagggaaccagactctgggattctgttcccacctcaaagggatctgagcccagagaaggagagcaaagctcctggggctgagaaggggtgtactccagtccccctgctcctgatctctcgtgtttcctcctagggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgc

SEQ ID NO: 1045 - DNA, 2059 bp, Homo sapiens
aaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgggtgtcctattttcctctgaagagagattctggccaattaagaatgttggaccttcagcttgcaaagcactctgataagtgttccttgagagcttataaatctagttgggtagaaaaggcataaaaacatagggaagtgtaatagcattagaagagctaaaaaggtatttggattacaatgtaagtggtgtcagaaggcccataaatacctgatgagcttgtaagaattcagacaaaagtgattgtgatagatgggctaggattattaaggaagatacacaagggaggcaggccttagaaagagatggatttggccgggcgctgtggcttacacctgtaatcccagcactttgggaggccaaggcaggtggatcatgaggtcaggagtttgagaccagcctggccaacgtggcgaaaccccgtctctactaaaaaatacaaaaattagctgggcttggtggcacatgcctgtaatcccagctacttgggaggctgaggctggagaatcacatgagcccaggaagggaagttgcagtgagccgagatcactgcactccagcctgggtga

SEQ ID NO: 1046 - DNA, 721 bp, Homo sapiens
gcccggctaattttgtatttttagtagagacaaggtttcaccatgttggtcaggctggtctcgaacttctgacctcaggtgatctgcctgccttggcctcccaaagtgctggattacaggcgtgagccaccgcacccagccccctgtgagagctctttgttgttaaaataatcttctttcttttatgctgaagatatttttctacttctattgtttatctctttactttcctttcttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacccgcaccctcagattgtatatgtagtctcctagattctctttcaggatttgtatgattttaaggttttcattttttttttaaagccagtcaaatttagca

SEQ ID NO: 1047 - DNA, 766 bp, Homo sapiens
tatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaagtttctgggtttccagtcttggttaagaaggtcacccgcaccctcagattgtatatgtagtctcctagattctctttcaggatttgtatgattttaaggttttcattttttttttaaagccagtcaaatttagca

SEQ ID NO: 1048 - DNA, 220 bp, Artificial Sequence
  Synthetic oligonucleotide
aaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggag

SEQ ID NO: 1049 - DNA, 549 bp, Artificial Sequence
  Synthetic oligonucleotide
ggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtg

SEQ ID NO: 1050 - DNA, 152 bp, Artificial Sequence
  Synthetic oligonucleotide
cagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaag

SEQ ID NO: 1051 - DNA, 192 bp, Artificial Sequence
  Synthetic oligonucleotide
gttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaag

SEQ ID NO: 1052 - DNA, 257 bp, Artificial Sequence
  Synthetic oligonucleotide
tatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccag

SEQ ID NO: 1053 - DNA, 129 bp, Artificial Sequence
  Synthetic oligonucleotide
aactccatccgccacaacctttccctgcacgacatgtttgtccgggagacgtctgccaatggcaaggtctccttctggaccattcaccccagtgccaaccgctacttgacattggaccaggtgtttaag

SEQ ID NO: 1054 - DNA, 316 bp, Artificial Sequence
  Synthetic oligonucleotide
gaagggtccctatggccatgttttgtctaggtgccagccctagacacagaacaccctgagggtcaggcacacacccacttccctccccttccatgggcatcacaagggcacactgagcagagcagggcacagcaggggagcatgctgcagcagccacaagcgcatggcaccagcctcaggggcggcagttcgttcgctcacttttgtgcctagcttttctttgccacgcatatagctacctgctctggcatcccccaggggtgttgaggacacgtgggtgaagcggtagtgccactctgccatcatgtgtctgtag

SEQ ID NO: 1055 - DNA, 132 bp, Artificial Sequence
  Synthetic oligonucleotide
gttggcctcctctctctgggctgtcattaactcaagcacacaccaccagagcagctggtggggttttgccatcccctctttaccttattgtgttaacataggtttctttctctccccatctgccacaagcag

SEQ ID NO: 1056 - DNA, 187 bp, Artificial Sequence
  Synthetic oligonucleotide
gttagtatgggagagtgggccttgggcctggtccttgttctggggccatatctttagggaaccagactctgggattctgttcccacctcaaagggatctgagcccagagaaggagagcaaagctcctggggctgagaaggggtgtactccagtccccctgctcctgatctctcgtgtttcctcctag

SEQ ID NO: 1057 - DNA, 176 bp, Artificial Sequence
  Synthetic oligonucleotide
ggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaag

SEQ ID NO: 1058 - DNA, 571 bp, Artificial Sequence
  Synthetic oligonucleotide
gtgggtgtcctattttcctctgaagagagattctggccaattaagaatgttggaccttcagcttgcaaagcactctgataagtgttccttgagagcttataaatctagttgggtagaaaaggcataaaaacatagggaagtgtaatagcattagaagagctaaaaaggtatttggattacaatgtaagtggtgtcagaaggcccataaatacctgatgagcttgtaagaattcagacaaaagtgattgtgatagatgggctaggattattaaggaagatacacaagggaggcaggccttagaaagagatggatttggccgggcgctgtggcttacacctgtaatcccagcactttgggaggccaaggcaggtggatcatgaggtcaggagtttgagaccagcctggccaacgtggcgaaaccccgtctctactaaaaaatacaaaaattagctgggcttggtggcacatgcctgtaatcccagctacttgggaggctgaggctggagaatcacatgagcccaggaagggaagttgcagtgagccgagatcactgcactccagcctgggtga

SEQ ID NO: 1059 - DNA, 587 bp, Artificial Sequence
  Synthetic oligonucleotide
gcccggctaattttgtatttttagtagagacaaggtttcaccatgttggtcaggctggtctcgaacttctgacctcaggtgatctgcctgccttggcctcccaaagtgctggattacaggcgtgagccaccgcacccagccccctgtgagagctctttgttgttaaaataatcttctttcttttatgctgaagatatttttctacttctattgtttatctctttactttcctttcttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacag

SEQ ID NO: 1060 - DNA, 134 bp, Artificial Sequence
  Synthetic oligonucleotide
tttctgggtttccagtcttggttaagaaggtcacccgcaccctcagattgtatatgtagtctcctagattctctttcaggatttgtatgattttaaggttttcattttttttttaaagccagtcaaatttagca

SEQ ID NO: 1061 - DNA, 168 bp, Artificial Sequence
  Synthetic oligonucleotide
gtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaa

SEQ ID NO: 1062 - DNA, 538 bp, Artificial Sequence
  Synthetic oligonucleotide
aggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaag

SEQ ID NO: 1063 - DNA, 284 bp, Artificial Sequence
  Synthetic oligonucleotide
gctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgccc

SEQ ID NO: 1064 - DNA, 462 bp, Artificial Sequence
  Synthetic oligonucleotide
ctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaa

SEQ ID NO: 1065 - DNA, 164 bp, Artificial Sequence
  Synthetic oligonucleotide
atgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccag

SEQ ID NO: 1066 - DNA, 45 bp, Artificial Sequence
  Synthetic oligonucleotide
ccactggacccagggtctccacaattgcccgagcacttggaatca

SEQ ID NO: 1067 - DNA, 61 bp, Artificial Sequence
  Synthetic oligonucleotide
gccacccacctgcccactcatcacagttttggagactgctcgcctacgtccatcccctcag

SEQ ID NO: 1068 - DNA, 70 bp, Artificial Sequence
  Synthetic oligonucleotide
cagcagaaacgaccgaatccagagctccgccggaacatgaccatcaaaaccgaactccccctgggcgcac

SEQ ID NO: 1069 - DNA, 52 bp, Artificial Sequence
  Synthetic oligonucleotide
gtggagagccctcccttggaagagtggccctccccggccccatctttcaaag

SEQ ID NO: 1070 - DNA, 37 bp, Artificial Sequence
  Synthetic oligonucleotide
ctgtgctcaagctgtccaccatcccgggcactccaag

SEQ ID NO: 1071 - DNA, 87 bp, Artificial Sequence
  Synthetic oligonucleotide
gctcagtgcaccccaagcctctgagtgaggacagcaggcagggactgttctgctcctcatagctccctgctgcctgattatgcaaaa

SEQ ID NO: 1072 - DNA, 6 bp, Artificial Sequence
  Synthetic oligonucleotide
gtagca

SEQ ID NO: 1073 - DNA, 8 bp, Artificial Sequence
  Synthetic oligonucleotide
gtcacacc

SEQ ID NO: 1074 - DNA, 89 bp, Artificial Sequence
  Synthetic oligonucleotide
gtcagctttcctgcaagaagaaatcctggttaaaaaagtcttttgtattgggtcaggagttgaatttggggtgggaggatggatgcaac

SEQ ID NO: 1075 - DNA, 23 bp, Artificial Sequence
  Synthetic oligonucleotide
tgaagcagagtgtgggtgcccag

SEQ ID NO: 1076 - DNA, 66 bp, Artificial Sequence
  Synthetic oligonucleotide
ctgaccgcatgggtgtgagccagcttgagaacactaactactcaataaaagcgaaggtggacatgc

SEQ ID NO: 1077 - DNA, 8843 bp, Homo sapiens
ctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtctcaaaacgtctgggctcaagcaatccccctgtcttgggctctgaaagcacaggggttacagggatgagccactgcgccgggcctgaagttaactgattacaatgtctgagaaagaactggagcgtgtagttagttgagcctcccgttggccaggcacagccaccttggtaagtgcatgtgtgtgtccttgttgtccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcgtcctcaggaaatcagggtgtgaggcaactggacgtggatggctccggttccccccggccactgtcctgaagccgccggaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctctgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcatgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccggctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagtggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccatgctgtgaactcacctgccacgggtctacacccactgtccgaagccctcggcccacacgggctccaggccttgggatgctttgcgttgcaccagggctgcagagcccagatcgctcactgtccaactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1078 - DNA, 2868 bp, Homo sapiens
ggtgccgcaggttgaggcgctgtgggcgccgccccgcccgccacgagcgcctacgtgatgcccggcccgtcgtctccacgagccccggccccgacacccgtgcgccgcgcgctccccaggcccgcagcgcagcctccccaggcccagcgccccccgcgggagacccgggtggcagcgccaggccccgccccgcagcccgccctgcagcgcccccgggaagtgctctggcgttagcattccagtaaaaggaccccagcatcaacgttcttcctgcagggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1079 - DNA, 2605 bp, Homo sapiens
tcaaaaccacctctacatatagaatgatctcctacatggttagaaggctggttattttgacacagctcaaaacaatttcgaataagttgaaatgacttcagagcctgtggcatgttcttagatgtgatcgaatgactcaacgtaaaaaattctgtccgacgatggatccgatacagccaacgaggagctctaaggttcatcttggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1080 - DNA, 2788 bp, Homo sapiens
atttaacattgaagagcggaaggtggcggagactcggcgcgccccaggccccgggtgcacgtgggggcgccggtgcccggatgatggagtgtcccgatccgtgcaatccctggcggggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1081 - DNA, 8218 bp, Homo sapiens
ctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtctcaaaacgtctgggctcaagcaatccccctgtcttgggctctgaaagcacaggggttacagggatgagccactgcgccgggcctgaagttaactgattacaatgtctgagaaagaactggagcgtgtagttagttgagcctcccgttggccaggcacagccaccttggtaagtgcatgtgtgtgtccttgttgtccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcgtcctcaggaaatcagggtgtgaggcaactggacgtggatggctccggttccccccggccactgtcctgaagccgccggaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctctgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcatgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccggctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagtggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccatgctgtgaactcacctgccacgggtctacacccactgtccgaagccctcggcccacacgggctccaggccttgggatgctttgcgttgcaccagggctgcagagcccagatcgctcactgtccaactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1082 - DNA, 9351 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtacgcaggcagttaccggtcctccctccagtggaactgcccgtgttccagggagctggggatgtgtcccagggcataagagagatgaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcagacgtttaccgctccttaattaaaaccacagactggggaaggcggccgggtggggaccggcgtggcgtcctgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1083 - DNA, 6789 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1084 - DNA, 6064 bp, Homo sapiens
ctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtctcaaaacgtctgggctcaagcaatccccctgtcttgggctctgaaagcacaggggttacagggatgagccactgcgccgggcctgaagttaactgattacaatgtctgagaaagaactggagcgtgtagttagttgagcctcccgttggccaggcacagccaccttggtaagtgcatgtgtgtgtccttgttgtccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcgtcctcaggaaatcagggtgtgaggcaactggacgtggatggctccggttccccccggccactgtcctgaagccgccggaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctctgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcatgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccggctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagtggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccatgctgtgaactcacctgccacgggtctacacccactgtccgaagccctcggcccacacgggctccaggccttgggatgctttgcgttgcaccagggctgcagagcccagatcgctcactgtccaactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1085 - DNA, 3863 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgatgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgatgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1086 - DNA, 4630 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtacgcaggcagttaccggtcctccctccagtggaactgcccgtgttccagggagctggggatgtgtcccagggcataagagagatgaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcagacgtttaccgctccttaattaaaaccacagactggggaaggcggccgggtggggaccggcgtggcgtcctgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1087 - DNA, 7593 bp, Homo sapiens
ctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtctcaaaacgtctgggctcaagcaatccccctgtcttgggctctgaaagcacaggggttacagggatgagccactgcgccgggcctgaagttaactgattacaatgtctgagaaagaactggagcgtgtagttagttgagcctcccgttggccaggcacagccaccttggtaagtgcatgtgtgtgtccttgttgtccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcgtcctcaggaaatcagggtgtgaggcaactggacgtggatggctccggttccccccggccactgtcctgaagccgccggaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctctgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcatgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccggctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagtggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccatgctgtgaactcacctgccacgggtctacacccactgtccgaagccctcggcccacacgggctccaggccttgggatgctttgcgttgcaccagggctgcagagcccagatcgctcactgtccaactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1088 - DNA, 4005 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgatgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgatgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggcctgggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1089 - DNA, 6233 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgacttcgtgtcttgatctgcctttgctgtcattcacgcatctgtcctcatgaaggcttaacctaccatgtttatcggaaatctcagcctaaattcgatttttacctagagatgaggaatgtgttaaatcactctactccacaaggaaccaaaccaaacagcatcagcaccaggctgagtcgcggaaaggatctgtcagaccgctccactggcatcgactcagctcgggagctacgttcaaagaaggaggacatttaaggtgaaagggttgcaggcagaggggcctggagcagcaggaggccacctcccaaaggctccactcccaggggccaacagagagaccacatccagaattgaaccagggatacgcagacaccaacggagaagacatgagcgtcaacctcctccacggagcagcacggcttctctactgacatccatgaactagactacaactctctaagttaatcaaatttactaagttagttatcaccgacatcactgttccatgtcaaatccatggattcatgagtcaaagaaacagcagtgaacagccttcaggctacggtttgggccattcctctgccagcgtattccagccaaagtctgttttcctatcagactactcactgcaaggcacagaagtgagcgcgggatctaaggccacaccgcagggtctgaactcacttaactggcccaacactgcacaagatacttaatcctcctgaacctcagtttcttcatctgcgtacgggggatatgaacccccacatgctggactgctctgagaattgagttaatgcgtgtaaaacatgagagctgctctggcacccgccaggcgctcaccgggcgccagcaccaccagtgcatacctcgaccgtgtgtgggcgcacaggcctccgttcctttttactccgaccgatgcttctaaggaagtcttcgaccgctttttctgtctgaggcatctgctgaggagtcgcattcactgaacacctgtttgaaaaattacgtatacataaaaccactgttagaaaaaacagttttagtaattcatcacattttgtataactcaataatgttgtttttatagaaaatactgttcagagtgttaaacagcagccaaatgtggaaatgccacggccgcctccctgctctgcagtgcttcaggttatcaagagatttccgcacagttcaatgtggcagctaatgaagccgtccatacgcggagcctgtgactctaaactctagttcttctgaagagcaaagaaaatacagagactattaagatctgctaaccgtgccttcggaattacactatcaaaacactgacaacttttaaaattactgtccagaagtcatcaatttgaaaatgtgaactggttgttaaagcagaacattataaagtgcaaaaaaataccatgctctcaaagttacatgaaaatagaactcttccaaattccacagaattgcaaatactactatcatataaaagctacttgaactctacagtatattgacagagtgtatattttttcctttcagctgtaaatcctgaacttattctagttaaagtaacagcaggtaccattatattaatactaactatatcccaggcatgtatgctgccttgcagatattctttcttttattccttacgataaacctgcaaaggaaggttttatggaggaggaagcagaagacgcaagtgggtcagctgcccaggaccgcctgggagcgagtgtgagtgctgacccggcggcaccagaagccaggcctgcctgagcccaatgccaagagaccctgatcgccaggcttcacctctggccacccacagaccgccctgtagaatctgccagggattctcaggacatgactggggaaaggcatcaggactctctgtgaagaaggacaagtgacttcagcaaacattttcttgttaagtactgatgaatacatcaatgtcactgacaataagatgctgaaaataaacaatcatttttaaactttattcatgctcacacatctgagggcataaggccaactgaaggtataggactgagctgccagatgtttcctcaaagcatcacataattttataagaaactgcacttttactctggtcttcagcaagctcacctttacagatacctcagttacggaccatgtgcttttggaagcaatataactacttgccctcaatctatttgcacttctagcacaaaattagcctgctttcttccccatctcctacaacttttaataggcttaaaatattttcttagtttgttagaacacttgacatttacaataaattctataacctttaccaagcactctatcttgaagtttctacaagtaagaaatacctaaaaactatacttaatagaatgaatcataaaatatttagaaacaaatcacacatgcacctcatattatcaccatttaacaagtgtttcttgatacgcgggagcttcctcaggatgggtttgatatctgtcatttctgcaatcctcttcatcagccgcacctaagccagaggaaactcgctcagagagaggcagaggctacaacagacccgctgagtctgaaccaagcacctgtgacatcagaaccctgcttgggcaggggttatgtgtgcgagtgcacggcttgggcagggctggaactgggatgcagggtggtacaaagaggaagatgagtcaaaaccaaccaaccaattcttccccatatttagtcagttagaaagttagcatttctgggacataaattaatgtattcccaaagaaattagtaactctggaatatgtggctaaaccggagtaatagaggttccttccaagcttcccacctgatccatcccgctgaaggtctcctgcaggtcccctgcgggcgtgagggtccggcctgccctgatggatgcgtacaggtgcccagagtcaggaattccattggcgagctcctgggcggtcatcttcaccagcaccttgaagtgctcctcttcttcaaagcacgggctatggaaaaaggagaagaaaaaattcctggagacccattcctcacgtcccttcagtatcatggaaagttgattaagttttcagagtactttaacaaccaaagaaattttataagtccatatgaactacaagtaaaagtcagacttggaaaacaacaacacacacgagtaaaactgtctcctttaaagtacttcaaacaaagatctctagtacaccccaagaatggacaactcttgcaaataaagttacttgttaaatatttcactccatagctgcatcatgtctggcaggtttcgatccaggcagagagaggagaaaagcacaccctgaaccaaggaaaacacagaagaaaggaattagggccgaattgaacagtgacagacactggagaaaagcttcccaccgcagcagtcgtctgacggtaccaggctacctgctcgtaggtgtccatgtgtgagtcgtcggggagcacgtggggagaagcactcatccctccggtcttcaattctatctgctgagcctgctcccggtagtcaagaaggccgcagcccagcctgacacagcagagaagcatcgccccgattacaagtcagtctttactgaatcatttttaaaatcgtgcatcttgagttacaagttgcttccattaattcaataactgcggctttgccaacctctctacacttcgaaggtcataagcaggtgcactctggccttcgccctcgagagttcatgtgcccccttccccagggagaccccagtttctcccgcctaggaagttagcgtccagaggcacaagacacttgggcagccagtgtctgcacttaaaacaccattctaaaataggcatttccagttgtaagctcttcaataaatgttttatgactactcc

SEQ ID NO: 1090 - DNA, 3537 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgatgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgatgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1091 - DNA, 3805 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgacttcgtgtcttgatctgcctttgctgtcattcacgcatctgtcctcatgaaggcttaacctaccatgtttatcggaaatctcagcctaaattcgatttttacctagagatgaggaatgtgttaaatcactctactccacaaggaaccaaaccaaacagcatcagcaccaggctgagtcgcggaaaggatctgtcagaccgctccactggcatcgactcagctcgggagctacgttcaaagaagggacccaaggattgagaagaacaatggattttttgatgtgtggtgcaacaaacgcatagctgagggctgtaaatcgggatggatcagtcggtctgcccaccagccgtgagggaagtggggagaagctgtcaccccaacttgagttcaagaagactccttggaagaaaagaccaccaaattgagaatgaaaagtaagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtactaactctggcattgtagcgatatctccaagagaaaattgttttgaacttttctgggaaaagttcacatacgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtagtacggaactgcacgctagggaagagagaggaatggcacgctagggaaggagaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattt

SEQ ID NO: 1092 - DNA, 3692 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagaatgtgttaaatcactctactccacaaggaaccaaaccaaacagcatcagcaccaggctgagtcgcggaaaggatctgtcagaccgctccactggcatcgactcagctcgggagctacgttcaaagaagggacccaaggattgagaagaacaatggattttttgatgtgtggtgcaacaaacgcatagctgagggctgtaaatcgggatggatcagtcggtctgcccaccagccgtgagggaagtggggagaagctgtcaccccaacttgagttcaagaagactccttggaagaaaagaccaccaaattgagaatgaaaagtaagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtactaactctggcattgtagcgatatctccaagagaaaattgttttgaacttttctgggaaaagttcacatacgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtagtacggaactgcacgctagggaagagagaggaatggcacgctagggaaggagaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattt

SEQ ID NO: 1093 - DNA, 3672 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagaatgtgttaaatcactctactccacaaggaaccaaaccaaacagcatcagcaccaggctgagtcgcggaaaggatctgtcagaccgctccactggcatcgactcagctcgggagctacgttcaaagaagggacccaaggattgagaagaacaatggattttttgatgtgtggtgcaacaaacgcatagctgagggctgtaaatcgggatggatcagtcggtctgcccaccagccgtgagggaagtggggagaagctgtcaccccaacttgagttcaagaagactccttggaagaaaagaccaccaaattgagaatgaaaaggacagtaagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtactaactctggcattgtagcgatatctccaagagaaaattgttttgaacttttctgggaaaagttcacatacgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtagtacggaactgcacgctagggaaggagaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattt

SEQ ID NO: 1094 - DNA, 4007 bp, Homo sapiens
agacacaggctccttgaagacgcccgtggtgagatcagccccaggtcgccgcttccacagacaggccttttcctaaagtggatgaagggagtcaaataggccagcttcgtgtcttgatctgcctttgctgtcattcacgcatctgtcctcatgaaggcttaacctaccatgtttatcggaaatctcagcctaaattcgatttttacctagagatgaggaatgtgttaaatcactctactccacaaggaaccaaaccaaacagcatcagcaccaggctgagtcgcggaaaggatctgtcagaccgctccactggcatcgactcagctcgggagctacgttcaaagaaggaggacatttaaggtgaaagggttgcaggcagaggggcctggagcagcaggaggccacctcccaaaggctccactcccaggggccaacagagagaccacatccagaattgaaccagggatacgcagacaccaacggagaagacatgagcgtcaacctcctccacggagcagcacggcttctctactgacatccatgaactagactacaactctctaagttaatcaaatttactaagttagttatcaccgacatcactgttccatgtcaaatccatggattcatgagtcaaagaaacagcagtgaacagccttcaggctacggtttgggccattcctctgccagcgtattccagccaaagtctgttttcctatcagactactcactgcaaggcacagaagtgagcgcgggatctaaggccacaccgcagggtctgaactcacttaactggcccaacactgcacaagatacttaatcctcctgaacctcagtttcttcatctgcgtacgggggatatgaacccccacatgctggactgctctgagaattgagttaatgcgtgtaaaacatgagagctgctctggcacccgccaggcgctcaccgggcgccagcaccaccagtgcatacctcgaccgtgtgtgggcgcacaggcctccgttcctttttactccgaccgatgcttctaaggaagtcttcgaccgctttttctgtctgaggcatctgctgaggagtcgcattcactgaacacctgtttgaaaaattacgtatacataaaaccactgttagaaaaaacagttttagtaattcatcacattttgtataactcaataatgttgtttttatagaaaatactgttcagagtgttaaacagcagccaaatgtggaaatgccacggccgcctccctgctctgcagtgcttcaggttatcaagagatttccgcacagttcaatgtggcagctaatgaagccgtccatacgcggagcctgtgactctaaactctagttcttctgaagagcaaagaaaatacagagactattaagatctgctaaccgtgccttcggaattacactatcaaaacactgacaacttttaaaattactgtccagaagtcatcaatttgaaaatgtgaactggttgttaaagcagaacattataaagtgcaaaaaaataccatgctctcaaagttacatgaaaatagaactcttccaaattccacagaattgcaaatactactatcatataaaagctacttgaactctacagtatattgacagagtgtatattttttcctttcagctgtaaatcctgaacttattctagttaaagtaacagcaggtaccattatattaatactaactatatcccaggcatgtatgctgccttgcagatattctttcttttattccttacgataaacctgcaaaggaaggttttatggaggaggaagcagaagacgcaagtgggtcagctgcccaggaccgcctgggagcgagtgtgagtgctgacccggcggcaccagaagccaggcctgcctgagcccaatgccaagagaccctgatcgccaggcttcacctctggccacccacagaccgccctgtagaatctgccagggattctcaggacatgactggggaaaggcatcaggactctctgtgaagaaggacaagtgacttcagcaaacattttcttgttaagtactgatgaatacatcaatgtcactgacaataagatgctgaaaataaacaatcatttttaaactttattcatgctcacacatctgagggcataaggccaactgaaggtataggactgagctgccagatgtttcctcaaagcatcacataattttataagaaactgcacttttactctggtcttcagcaagctcacctttacagatacctcagttacggaccatgtgcttttggaagcaatataactacttgccctcaatctatttgcacttctagcacaaaattagcctgctttcttccccatctcctacaacttttaataggcttaaaatattttcttagtttgttagaacacttgacatttacaataaattctataacctttaccaagcactctatcttgaagtttctacaagtaagaaatacctaaaaactatacttaatagaatgaatcataaaatatttagaaacaaatcacacatgcacctcatattatcaccatttaacaagtgtttcttgatacgcgggagcttcctcaggatgggtttgatatctgtcatttctgcaatcctcttcatcagccgcacctaagccagaggaaactcgctcagagagaggcagaggctacaacagacccgctgagtctgaaccaagcacctgtgacatcagaaccctgcttgggcaggggttatgtgtgcgagtgcacggcttgggcagggctggaactgggatgcagggtggtacaaagaggaagatgagtcaaaaccaaccaaccaattcttccccatatttagtcagttagaaagttagcatttctgggacataaattaatgtattcccaaagaaattagtaactctggaatatgtggctaaaccggagtaatagaggttccttccaagcttcccacctgatccatcccgctgaaggtctcctgcaggtcccctgcgggcgtgagggtccggcctgccctgatggatgcgtacaggtgcccagagtcaggaattccattggcgagctcctgggcggtcatcttcaccagcaccttgaagtgctcctcttcttcaaagcacgggctatggaaaaaggagaagaaaaaattcctggagacccattcctcacgtcccttcagtatcatggaaagttgattaagttttcagagtactttaacaaccaaagaaattttataagtccatatgaactacaagtaaaagtcagacttggaaaacaacaacacacacgagtaaaactgtctcctttaaagtacttcaaacaaagatctctagtacaccccaagaatggacaactcttgcaaataaagttacttgttaaatatttcactccatagctgcatcatgtctggcaggtttcgatccaggcagagagaggagaaaagcacaccctgaaccaaggaaaacacagaagaaaggaattagggccgaattgaacagtgacagacactggagaaaagcttcccaccgcagcagtcgtctgacggtaccaggctacctgctcgtaggtgtccatgtgtgagtcgtcggggagcacgtggggagaagcactcatccctccggtcttcaattctatctgctgagcctgctcccggtagtcaagaaggccgcagcccagcctgacacagcagagaagcatcgccccgattacaagtcagtctttactgaatcatttttaaaatcgtgcatcttgagttacaagttgcttccattaattcaataactgcggctttgccaacctctctacacttcgaaggtcataagcaggtgcactctggccttcgccctcgagagttcatgtgcccccttccccagggagaccccagtttctcccgcctaggaagttagcgtccagaggcacaagacacttgggcagccagtgtctgcacttaaaacaccattctaaaataggcatttccagttgtaagctcttcaataaatgttttatgactactcc

SEQ ID NO: 1095 - DNA, 572 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtaggtactgggctgcgtccacagggttctctgagttagagactcttttatgtctagtaaattcccagaacacttgagctcagatcagttgcgaaatagagattatgtggaccgaacagactttgtgagcagctctttacttgtggtttgatttttagaaatgcatgtgttaatctgtgagtcactttgagtacttgttaata

SEQ ID NO: 1096 - DNA, 490 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgaaataatccaaatcggtgcctccccgctgaagacgctcatggggcccacaccttcgtgctggtccaggctctctctgcattgggcgcctcctgagctccgacacatcagaagagaggtgga

SEQ ID NO: 1097 - DNA, 217 bp, Artificial Sequence
  Synthetic oligonucleotide
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaag

SEQ ID NO: 1098 - DNA, 276 bp, Artificial Sequence
  Synthetic oligonucleotide
ggtgccgcaggttgaggcgctgtgggcgccgccccgcccgccacgagcgcctacgtgatgcccggcccgtcgtctccacgagccccggccccgacacccgtgcgccgcgcgctccccaggcccgcagcgcagcctccccaggcccagcgccccccgcgggagacccgggtggcagcgccaggccccgccccgcagcccgccctgcagcgcccccgggaagtgctctggcgttagcattccagtaaaaggaccccagcatcaacgttcttcctgcag

SEQ ID NO: 1099 - DNA, 203 bp, Artificial Sequence
  Synthetic oligonucleotide
tcaaaaccacctctacatatagaatgatctcctacatggttagaaggctggttattttgacacagctcaaaacaatttcgaataagttgaaatgacttcagagcctgtggcatgttcttagatgtgatcgaatgactcaacgtaaaaaattctgtccgacgatggatccgatacagccaacgaggagctctaaggttcatctt

SEQ ID NO: 1100 - DNA, 203 bp, Artificial Sequence
  Synthetic oligonucleotide
gtaggtactgggctgcgtccacagggttctctgagttagagactcttttatgtctagtaaattcccagaacacttgagctcagatcagttgcgaaatagagattatgtggaccgaacagactttgtgagcagctctttacttgtggtttgatttttagaaatgcatgtgttaatctgtgagtcactttgagtacttgttaata

SEQ ID NO: 1101 - DNA, 121 bp, Artificial Sequence
  Synthetic oligonucleotide
aaataatccaaatcggtgcctccccgctgaagacgctcatggggcccacaccttcgtgctggtccaggctctctctgcattgggcgcctcctgagctccgacacatcagaagagaggtgga

SEQ ID NO: 1102 - DNA, 190 bp, Artificial Sequence
  Synthetic oligonucleotide
ggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacg

SEQ ID NO: 1103 - DNA, 166 bp, Artificial Sequence
  Synthetic oligonucleotide
gccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagag

SEQ ID NO: 1104 - DNA, 844 bp, Artificial Sequence
  Synthetic oligonucleotide
gtaaagcgctcagaggaaccggcgggaggccagtggggcccgatgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgatgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaag

SEQ ID NO: 1105 - DNA, 326 bp, Artificial Sequence
  Synthetic oligonucleotide
gtatctgggaaagagcccagcacggggcctgggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccag

SEQ ID NO: 1106 - DNA, 142 bp, Artificial Sequence
  Synthetic oligonucleotide
gtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttag

SEQ ID NO: 1107 - DNA, 126 bp, Artificial Sequence
  Synthetic oligonucleotide
gccagccgcatgggagtggaggcagtcatcgccttgctagaggccaccccggacaccccagcttgcgtcgtgtcactgaacgggaaccacgccgtgcgcctgccgctgatggagtgcgtgcagatg

SEQ ID NO: 1108 - DNA, 147 bp, Artificial Sequence
  Synthetic oligonucleotide
accaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccag

SEQ ID NO: 1109 - DNA, 214 bp, Artificial Sequence
  Synthetic oligonucleotide
gtaacttccaaatctcaactctatgacctgcttttaaggaagaaggaagagccgtgttctgggagagaatcgctgggtgccgacgccagttggattcctggaaaggcgtccctaagggaggggtacgcaggcagttaccggtcctccctccagtggaactgcccgtgttccagggagctggggatgtgtcccagggcataagagagatgaggag

SEQ ID NO: 1110 - DNA, 1723 bp, Artificial Sequence
  Synthetic oligonucleotide
gtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcagacgtttaccgctccttaattaaaaccacagactggggaaggcggccgggtggggaccggcgtggcgtcctgcggaccgcgtggagtttggggtgtctgacatcgttctccacgtggctattttcag

SEQ ID NO: 1111 - DNA, 138 bp, Artificial Sequence
  Synthetic oligonucleotide
ctggagctgtcagccgcccgggagaagcacgaggagttctgtgtccccatggtcatggttcccgctactgtgtccaacaatgtgccgggttccgatttcagcatcggggcagacaccgccctgaacactatcaccgac

SEQ ID NO: 1112 - DNA, 2592 bp, Artificial Sequence
  Synthetic oligonucleotide
ctgcaatcgctattcactgcagcctcgacctcccaggcttaggtgatcctcccacctcagcctcctgagtagctgggactacaggtgggtgccaccgtgcccagctaattttttgtatttctatagagacggggtctccctgtgttgcccaggctggtctcaaaacgtctgggctcaagcaatccccctgtcttgggctctgaaagcacaggggttacagggatgagccactgcgccgggcctgaagttaactgattacaatgtctgagaaagaactggagcgtgtagttagttgagcctcccgttggccaggcacagccaccttggtaagtgcatgtgtgtgtccttgttgtccttctgatcctgagctccaaggaacaaggctgtcttgggagtgcggtggttctagtctcgtgatgggtgagtggcgccgtctgaccgaggtcaccctggcgaatgctgtggctgctcgggagctggggcagagaagagaaagccgctgagggtccctctgtggaccctgaagggagagggaccgatatgtgaacatggcagctgttttctccagagccctgtttactgacggccgaacagtgtgaatcctgagacggtttggatttgggtctgaactgggctcgtctggccacagaagaacatgagctggtggcgtcctcaggaaatcagggtgtgaggcaactggacgtggatggctccggttccccccggccactgtcctgaagccgccggaggctgaggacgcatgggagtgagcgtctcttccctgtccggccacaccctctgtgactggtgactcatggcgtggccctgggcagcatttaggtttgaggtctgtagatggctccagtatactggcttctcttgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctctgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcatgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaaggtgccaagacccccacctgccctcctgtgtgcctcaggcccctcctggtcccaggtcacccacaccgtctggcttccagcgagcgcttctcggagaaacagccggctccccacagccagtcttggtcagtcctgagctcgggtactccaaagtgaagtgagcgacatcacctgtctgaaaagcataaggagactcccacgtggcggtgctgaggggccacatcctgggcaccaggccagccagtgccccgacatgagtgttgctggccgggaagcagctggcatttggattgaagtcctgcaaaaactgccatggccagagcctgccaggcagagcctgcacagagtggcccaagagctgggcacgtgctgggcctgggtggatgtggaggctgtgccatggggcgcgggggaccctgctcacagctcaccttgtggtcacccagcactgaccctgctcacagctcgccttgtggtcacccagcactgacccacccgccccaccctcctatccaccatgctgtgaactcacctgccacgggtctacacccactgtccgaagccctcggcccacacgggctccaggccttgggatgctttgcgttgcaccagggctgcagagcccagatcgctcactgtccaactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcag

SEQ ID NO: 1113 - DNA, 625 bp, Artificial Sequence
  Synthetic oligonucleotide
gttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcag

SEQ ID NO: 1114 - DNA, 153 bp, Artificial Sequence
  Synthetic oligonucleotide
gcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgag

SEQ ID NO: 1115 - DNA, 625 bp, Artificial Sequence
  Synthetic oligonucleotide
gtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacaccctcctgggcaggcggtttcaccaacatgtgccttgggaggggtggattctgccagtcgtgggtgtggtgctgacacccgcatggtggcccctccggtccctgatactctgacctacctctatggtcataagctggacatgaagacctatggtagttccacag

SEQ ID NO: 1116 - DNA, 361 bp, Artificial Sequence
  Synthetic oligonucleotide
gcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcct

SEQ ID NO: 1117 - DNA, 627 bp, Artificial Sequence
  Synthetic oligonucleotide
gtgcgtccgagcctcagcctcccactcgagctgaggggcgtgtcctggccatctctctcctgggcttctccctgtgttccccagtgctgtggtggtcttgcagaggctggcctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccttgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcag

SEQ ID NO: 1118 - DNA, 176 bp, Artificial Sequence
  Synthetic oligonucleotide
ggggtggcgtctgctgggggcacatcccatcgtgcagggggaacggctgaggtcacaggctttgcctgacaagtgccactcacggctgctgtccacgtgccagccctgggacacagccctctgccatccttccacccactcggaggccagggaggcacctccgtgccacactgcag

SEQ ID NO: 1119 - DNA, 2779 bp, Artificial Sequence
  Synthetic oligonucleotide
gcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccag

SEQ ID NO: 1120 - DNA, 165 bp, Artificial Sequence
  Synthetic oligonucleotide
acctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcag

SEQ ID NO: 1121 - DNA, 202 bp, Artificial Sequence
  Synthetic oligonucleotide
cgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaatctg

SEQ ID NO: 1122 - DNA, 131 bp, Artificial Sequence
  Synthetic oligonucleotide
gaatgtgttaaatcactctactccacaaggaaccaaaccaaacagcatcagcaccaggctgagtcgcggaaaggatctgtcagaccgctccactggcatcgactcagctcgggagctacgttcaaagaagg

SEQ ID NO: 1123 - DNA, 3659 bp, Artificial Sequence
  Synthetic oligonucleotide
aggacatttaaggtgaaagggttgcaggcagaggggcctggagcagcaggaggccacctcccaaaggctccactcccaggggccaacagagagaccacatccagaattgaaccagggatacgcagacaccaacggagaagacatgagcgtcaacctcctccacggagcagcacggcttctctactgacatccatgaactagactacaactctctaagttaatcaaatttactaagttagttatcaccgacatcactgttccatgtcaaatccatggattcatgagtcaaagaaacagcagtgaacagccttcaggctacggtttgggccattcctctgccagcgtattccagccaaagtctgttttcctatcagactactcactgcaaggcacagaagtgagcgcgggatctaaggccacaccgcagggtctgaactcacttaactggcccaacactgcacaagatacttaatcctcctgaacctcagtttcttcatctgcgtacgggggatatgaacccccacatgctggactgctctgagaattgagttaatgcgtgtaaaacatgagagctgctctggcacccgccaggcgctcaccgggcgccagcaccaccagtgcatacctcgaccgtgtgtgggcgcacaggcctccgttcctttttactccgaccgatgcttctaaggaagtcttcgaccgctttttctgtctgaggcatctgctgaggagtcgcattcactgaacacctgtttgaaaaattacgtatacataaaaccactgttagaaaaaacagttttagtaattcatcacattttgtataactcaataatgttgtttttatagaaaatactgttcagagtgttaaacagcagccaaatgtggaaatgccacggccgcctccctgctctgcagtgcttcaggttatcaagagatttccgcacagttcaatgtggcagctaatgaagccgtccatacgcggagcctgtgactctaaactctagttcttctgaagagcaaagaaaatacagagactattaagatctgctaaccgtgccttcggaattacactatcaaaacactgacaacttttaaaattactgtccagaagtcatcaatttgaaaatgtgaactggttgttaaagcagaacattataaagtgcaaaaaaataccatgctctcaaagttacatgaaaatagaactcttccaaattccacagaattgcaaatactactatcatataaaagctacttgaactctacagtatattgacagagtgtatattttttcctttcagctgtaaatcctgaacttattctagttaaagtaacagcaggtaccattatattaatactaactatatcccaggcatgtatgctgccttgcagatattctttcttttattccttacgataaacctgcaaaggaaggttttatggaggaggaagcagaagacgcaagtgggtcagctgcccaggaccgcctgggagcgagtgtgagtgctgacccggcggcaccagaagccaggcctgcctgagcccaatgccaagagaccctgatcgccaggcttcacctctggccacccacagaccgccctgtagaatctgccagggattctcaggacatgactggggaaaggcatcaggactctctgtgaagaaggacaagtgacttcagcaaacattttcttgttaagtactgatgaatacatcaatgtcactgacaataagatgctgaaaataaacaatcatttttaaactttattcatgctcacacatctgagggcataaggccaactgaaggtataggactgagctgccagatgtttcctcaaagcatcacataattttataagaaactgcacttttactctggtcttcagcaagctcacctttacagatacctcagttacggaccatgtgcttttggaagcaatataactacttgccctcaatctatttgcacttctagcacaaaattagcctgctttcttccccatctcctacaacttttaataggcttaaaatattttcttagtttgttagaacacttgacatttacaataaattctataacctttaccaagcactctatcttgaagtttctacaagtaagaaatacctaaaaactatacttaatagaatgaatcataaaatatttagaaacaaatcacacatgcacctcatattatcaccatttaacaagtgtttcttgatacgcgggagcttcctcaggatgggtttgatatctgtcatttctgcaatcctcttcatcagccgcacctaagccagaggaaactcgctcagagagaggcagaggctacaacagacccgctgagtctgaaccaagcacctgtgacatcagaaccctgcttgggcaggggttatgtgtgcgagtgcacggcttgggcagggctggaactgggatgcagggtggtacaaagaggaagatgagtcaaaaccaaccaaccaattcttccccatatttagtcagttagaaagttagcatttctgggacataaattaatgtattcccaaagaaattagtaactctggaatatgtggctaaaccggagtaatagaggttccttccaagcttcccacctgatccatcccgctgaaggtctcctgcaggtcccctgcgggcgtgagggtccggcctgccctgatggatgcgtacaggtgcccagagtcaggaattccattggcgagctcctgggcggtcatcttcaccagcaccttgaagtgctcctcttcttcaaagcacgggctatggaaaaaggagaagaaaaaattcctggagacccattcctcacgtcccttcagtatcatggaaagttgattaagttttcagagtactttaacaaccaaagaaattttataagtccatatgaactacaagtaaaagtcagacttggaaaacaacaacacacacgagtaaaactgtctcctttaaagtacttcaaacaaagatctctagtacaccccaagaatggacaactcttgcaaataaagttacttgttaaatatttcactccatagctgcatcatgtctggcaggtttcgatccaggcagagagaggagaaaagcacaccctgaaccaaggaaaacacagaagaaaggaattagggccgaattgaacagtgacagacactggagaaaagcttcccaccgcagcagtcgtctgacggtaccaggctacctgctcgtaggtgtccatgtgtgagtcgtcggggagcacgtggggagaagcactcatccctccggtcttcaattctatctgctgagcctgctcccggtagtcaagaaggccgcagcccagcctgacacagcagagaagcatcgccccgattacaagtcagtctttactgaatcatttttaaaatcgtgcatcttgagttacaagttgcttccattaattcaataactgcggctttgccaacctctctacacttcgaaggtcataagcaggtgcactctggccttcgccctcgagagttcatgtgcccccttccccagggagaccccagtttctcccgcctaggaagttagcgtccagaggcacaagacacttgggcagccagtgtctgcacttaaaacaccattctaaaataggcatttccagttgtaagctcttcaataaatgttttatgactactcc

SEQ ID NO: 1124 - DNA, 191 bp, Artificial Sequence
  Synthetic oligonucleotide
gacccaaggattgagaagaacaatggattttttgatgtgtggtgcaacaaacgcatagctgagggctgtaaatcgggatggatcagtcggtctgcccaccagccgtgagggaagtggggagaagctgtcaccccaacttgagttcaagaagactccttggaagaaaagaccaccaaattgagaatgaaaag

SEQ ID NO: 1125 - DNA, 754 bp, Artificial Sequence
  Synthetic oligonucleotide
taagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtactaactctggcattgtagcgatatctccaagagaaaattgttttgaacttttctgggaaaagttcacatacgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtagtacggaact

SEQ ID NO: 1126 - DNA, 261 bp, Artificial Sequence
  Synthetic oligonucleotide
gcacgctagggaaggagaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattt

SEQ ID NO: 1127 - DNA, 116 bp, Artificial Sequence
  Synthetic oligonucleotide
atttaacattgaagagcggaaggtggcggagactcggcgcgccccaggccccgggtgcacgtgggggcgccggtgcccggatgatggagtgtcccgatccgtgcaatccctggcgg

SEQ ID NO: 1128 - DNA, 116 bp, Artificial Sequence
  Synthetic oligonucleotide
ggctgggttctcagagaaagaaaacgtgatgcagcagaggatgggattgaagaaacaggagagtgaagtggaaatagcctggcccgcgtgacttaaaccggcccggagatgtgcgg

SEQ ID NO: 1129 - DNA, 74 bp, Artificial Sequence
  Synthetic oligonucleotide
gtatgaacgctgccgtccgtgccgtggtgcgcatgggtatctacgtgggggccaaggtgtacttcatctacgag

SEQ ID NO: 1130 - DNA, 78 bp, Artificial Sequence
  Synthetic oligonucleotide
ggctaccagggcatggtggacggaggctcaaacatcgcagaggccgactgggagagtgtctccagcatcctgcaagtg

SEQ ID NO: 1131 - DNA, 80 bp, Artificial Sequence
  Synthetic oligonucleotide
gtgctgtaaggggtgactggagggagaagcctggctgctggtcacaccgcttcccttgtcctggccggcatgctctggtg

SEQ ID NO: 1132 - DNA, 45 bp, Artificial Sequence
  Synthetic oligonucleotide
ccaccagaggaccttcgttctggaggtgatgggacgacactgtgg

SEQ ID NO: 1133 - DNA, 109 bp, Artificial Sequence
  Synthetic oligonucleotide
gtacctggccctggtgagtgccttggcctgcggtgcggactgggtgttccttccagaatctccaccagaggaaggctgggaggagcagatgtgtgtcaaactctcggag

SEQ ID NO: 1134 - DNA, 40 bp, Artificial Sequence
  Synthetic oligonucleotide
aaccgtgcccggaaaaaaaggctgaatattattattgtgg

SEQ ID NO: 1135 - DNA, 56 bp, Artificial Sequence
  Synthetic oligonucleotide
ctgaaggagcaattgatacccaaaataaacccatcacctctgagaaaatcaaagag

SEQ ID NO: 1136 - DNA, 93 bp, Artificial Sequence
  Synthetic oligonucleotide
cttgtcgtcacgcagctgggctatgacacacgtgtgaccatcctcgggcacgtgcagagaggagggaccccttcggcattcgacaggatcttg

SEQ ID NO: 1137 - DNA, 65 bp, Artificial Sequence
  Synthetic oligonucleotide
actcaggatgtgcagaaggcgatggacgagaggagatttcaagatgcggttcgactccgagggag

SEQ ID NO: 1138 - DNA, 70 bp, Artificial Sequence
  Synthetic oligonucleotide
gagctttgcgggcaacctgaacacctacaagcgacttgccatcaagctgccggatgatcagatcccaaag

SEQ ID NO: 1139 - DNA, 71 bp, Artificial Sequence
  Synthetic oligonucleotide
atcaaagaaatcggctggacagatgtcgggggctggaccggccaaggaggctccattcttgggacaaaacg

SEQ ID NO: 1140 - DNA, 21 bp, Artificial Sequence
  Synthetic oligonucleotide
cgttctcccggggaagtactt

SEQ ID NO: 1141 - DNA, 67 bp, Artificial Sequence
  Synthetic oligonucleotide
ggaagagatcgccacacagatgcgcacgcacagcatcaacgcgctgctgatcatcggtggattcgag

SEQ ID NO: 1142 - DNA, 15 bp, Artificial Sequence
  Synthetic oligonucleotide
gcctacctgggactc

SEQ ID NO: 1143 - DNA, 62 bp, Artificial Sequence
  Synthetic oligonucleotide
tccaacgtggagcacctgacggagaaaatgaagaccaccatccagagaggccttgtgctcag

SEQ ID NO: 1144 - DNA, 112 bp, Artificial Sequence
  Synthetic oligonucleotide
aaatgagagctgcagtgaaaactacaccaccgacttcatttaccagctgtattcagaagagggcaaaggcgtgtttgactgcaggaagaacgtgctgggtcacatgcagcag

SEQ ID NO: 1145 - DNA, 26 bp, Artificial Sequence
  Synthetic oligonucleotide
ggtggggcaccctctccatttgatag

SEQ ID NO: 1146 - DNA, 74 bp, Artificial Sequence
  Synthetic oligonucleotide
aaactttggaaccaaaatctctgccagagctatggagtggatcactgcaaaactcaaggaggcccggggcagag

SEQ ID NO: 1147 - DNA, 80 bp, Artificial Sequence
  Synthetic oligonucleotide
gaaaaaaatttaccaccgatgattccatttgtgtgctgggaataagcaaaagaaacgttatttttcaacctgtggcagag

SEQ ID NO: 1148 - DNA, 23 bp, Artificial Sequence
  Synthetic oligonucleotide
ctgaagaagcaaacggattttga

SEQ ID NO: 1149 - DNA, 95 bp, Artificial Sequence
  Synthetic oligonucleotide
gcacaggattcccaaagaacagtggtggctcaagctacggcccctcatgaaaatcctggccaagtacaaggccagctatgacgtgtcggactcag

SEQ ID NO: 1150 - DNA, 66 bp, Artificial Sequence
  Synthetic oligonucleotide
gccagctggaacatgtgcagccctggagtgtctgacccagtcccgcctgcatgtgcctgcagccac

SEQ ID NO: 1151 - DNA, 104 bp, Artificial Sequence
  Synthetic oligonucleotide
agacacaggctccttgaagacgcccgtggtgagatcagccccaggtcgccgcttccacagacaggccttttcctaaagtggatgaagggagtcaaataggccag

SEQ ID NO: 1152 - DNA, 113 bp, Artificial Sequence
  Synthetic oligonucleotide
cttcgtgtcttgatctgcctttgctgtcattcacgcatctgtcctcatgaaggcttaacctaccatgtttatcggaaatctcagcctaaattcgatttttacctagagatgag

SEQ ID NO: 1153 - DNA, 5 bp, Artificial Sequence
  Synthetic oligonucleotide
gacag

SEQ ID NO: 1154 - DNA, 25 bp, Artificial Sequence
  Synthetic oligonucleotide
gcacgctagggaagagagaggaatg

SEQ ID NO: 1155 - DNA, 3874 bp, Homo sapiens
gtgacccgcatattaagaggagagcgctcaatggcagccaggggaggagcagggaggctggttgggaggctgttgaagaaatcaggtgagaagtgatggaagcaccgaataagatggtcatgttggaaaaattgagaagctgaggtgcttagcattgattttcaaggtagagctactgagatttgctgatagatccaatgtatgctgggagagaaaattcagtcactctagagcattggctggatttgtcacccattgcagcgaatggagaaggtgctgacataaaagccctttagactgaaagctactgactgaggggatggtgccctagtttgatttcctggggtgtatgagtagcagggaggccaagagctgggcctcacgagattgtggggactacatcagggaagcaggcctgcaaagaacctgcaccacagacccccacctaaaagagcctccaaaaaccctaactggcatgacctgagtactttaactctgcttgtaactttcaaatatattttgatttgcttatgaccaccaaggcaaaacttcccatttcaataatgttagtagaaacataaacaggatgttaatttatttatttggtaattctttttatgaatattatccagtttaatcattagctctgaaggagatgaaaaataattttctaatttttagaaaaatttgcagctaattgggtgataaaggtaaggggtttctgagttcacaaaaatgttctaaaattggcaacagtttcggttgcacgtttcattaaatgtactaaaaaccattgaactgtacatggtatatggtgaattatatggtatgtgaattatatctcaacaagctgggtattgtttttttaaaaaataaaaataaaaaaggagaaagagagagagaaaaacaattgcagatcatcccagcactgaggacaagactaacttcagtgttccagtatatgccattataggttttacggcacacagtgatgatttggagcctatgatttgacctagggtacagcaggtactgtttagcaatcattttactattgtcataggtctctgctcttggagctaagtgcccagggtaaatgagatctttaatttgaaaagagatttttgatttgatgaatgtacattctccaaagggtcataaattgtcattctggatgtttgatctgtttgttgttttggtacaaaaattagaagaaaataattcactcataaaatgttaaataatgaactaaaagtcattcatcaagtccataacttagggtcacatttgtccttggagcaggagaaagagttgtgttcacccttttcttacttttgcttttgtcctaagtgcttcagagaagtacagggtggcaacagtgtttctactgagcagctgataccattgctatgcactcattcattatgcaggaaacatttagtaatttcaacataaatatgggactctgacgttctcctcttcattttgcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacctcc

SEQ ID NO: 1156 - DNA, 2590 bp, Homo sapiens
gaggaacgcgggcgggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacctcc

SEQ ID NO: 1157 - DNA, 2771 bp, Homo sapiens
gaggaacgcgggcgggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagaatggaggaaatgatagctactttctgcgtctgtatgtatgagttattgggggcatttcgaaccagtgacaaacattttgttaagcaatctggtgatgcattaagaagctggaagctgtgacccagaaaccccactcctgagaacttacctgcaatggaagaaacaaacaaacaaaaacagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacctcc

SEQ ID NO: 1158 - DNA, 207 bp, Artificial Sequence
  Synthetic oligonucleotide
gaggaacgcgggcgggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcag

SEQ ID NO: 1159 - DNA, 181 bp, Artificial Sequence
  Synthetic oligonucleotide
aatggaggaaatgatagctactttctgcgtctgtatgtatgagttattgggggcatttcgaaccagtgacaaacattttgttaagcaatctggtgatgcattaagaagctggaagctgtgacccagaaaccccactcctgagaacttacctgcaatggaagaaacaaacaaacaaaaacag

SEQ ID NO: 1160 - DNA, 1491 bp, Artificial Sequence
  Synthetic oligonucleotide
gtgacccgcatattaagaggagagcgctcaatggcagccaggggaggagcagggaggctggttgggaggctgttgaagaaatcaggtgagaagtgatggaagcaccgaataagatggtcatgttggaaaaattgagaagctgaggtgcttagcattgattttcaaggtagagctactgagatttgctgatagatccaatgtatgctgggagagaaaattcagtcactctagagcattggctggatttgtcacccattgcagcgaatggagaaggtgctgacataaaagccctttagactgaaagctactgactgaggggatggtgccctagtttgatttcctggggtgtatgagtagcagggaggccaagagctgggcctcacgagattgtggggactacatcagggaagcaggcctgcaaagaacctgcaccacagacccccacctaaaagagcctccaaaaaccctaactggcatgacctgagtactttaactctgcttgtaactttcaaatatattttgatttgcttatgaccaccaaggcaaaacttcccatttcaataatgttagtagaaacataaacaggatgttaatttatttatttggtaattctttttatgaatattatccagtttaatcattagctctgaaggagatgaaaaataattttctaatttttagaaaaatttgcagctaattgggtgataaaggtaaggggtttctgagttcacaaaaatgttctaaaattggcaacagtttcggttgcacgtttcattaaatgtactaaaaaccattgaactgtacatggtatatggtgaattatatggtatgtgaattatatctcaacaagctgggtattgtttttttaaaaaataaaaataaaaaaggagaaagagagagagaaaaacaattgcagatcatcccagcactgaggacaagactaacttcagtgttccagtatatgccattataggttttacggcacacagtgatgatttggagcctatgatttgacctagggtacagcaggtactgtttagcaatcattttactattgtcataggtctctgctcttggagctaagtgcccagggtaaatgagatctttaatttgaaaagagatttttgatttgatgaatgtacattctccaaagggtcataaattgtcattctggatgtttgatctgtttgttgttttggtacaaaaattagaagaaaataattcactcataaaatgttaaataatgaactaaaagtcattcatcaagtccataacttagggtcacatttgtccttggagcaggagaaagagttgtgttcacccttttcttacttttgcttttgtcctaagtgcttcagagaagtacagggtggcaacagtgtttctactgagcagctgataccattgctatgcactcattcattatgcaggaaacatttagtaatttcaacataaatatgggactctgacgttctcctcttcattttgcag

SEQ ID NO: 1161 - DNA, 1063 bp, Artificial Sequence
  Synthetic oligonucleotide
cacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctccttt

SEQ ID NO: 1162 - DNA, 284 bp, Artificial Sequence
  Synthetic oligonucleotide
cagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaa

SEQ ID NO: 1163 - DNA, 386 bp, Artificial Sequence
  Synthetic oligonucleotide
ttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacctcc

SEQ ID NO: 1164 - DNA, 19 bp, Artificial Sequence
  Synthetic oligonucleotide
agcagtcattatggcgaac

SEQ ID NO: 1165 - DNA, 35 bp, Artificial Sequence
  Synthetic oligonucleotide
cttggctgctggatgctggttctctttgtggccac

SEQ ID NO: 1166 - DNA, 53 bp, Artificial Sequence
  Synthetic oligonucleotide
atggagtgacctgggcctctgcaagaagcgcccgaagcctggaggatggaaca

SEQ ID NO: 1167 - DNA, 6 bp, Artificial Sequence
  Synthetic oligonucleotide
ctgggg

SEQ ID NO: 1168 - DNA, 4 bp, Artificial Sequence
  Synthetic oligonucleotide
gcag

SEQ ID NO: 1169 - DNA, 53 bp, Artificial Sequence
  Synthetic oligonucleotide
ccgatacccggggcagggcagccctggaggcaaccgctacccacctcagggcg

SEQ ID NO: 1170 - DNA, 7 bp, Artificial Sequence
  Synthetic oligonucleotide
gtggtgg

SEQ ID NO: 1171 - DNA, 17 bp, Artificial Sequence
  Synthetic oligonucleotide
ctgggggcagcctcatg

SEQ ID NO: 1172 - DNA, 7 bp, Artificial Sequence
  Synthetic oligonucleotide
gtggtgg

SEQ ID NO: 1173 - DNA, 41 bp, Artificial Sequence
  Synthetic oligonucleotide
ctgggggcagcctcatggtggtggctgggggcagccccatg

SEQ ID NO: 1174 - DNA, 17 bp, Artificial Sequence
  Synthetic oligonucleotide
gtggtggctggggacag

SEQ ID NO: 1175 - DNA, 7 bp, Artificial Sequence
  Synthetic oligonucleotide
cctcatg

SEQ ID NO: 1176 - DNA, 7 bp, Artificial Sequence
  Synthetic oligonucleotide
gtggtgg

SEQ ID NO: 1177 - DNA, 61 bp, Artificial Sequence
  Synthetic oligonucleotide
ctggggtcaaggaggtggcacccacagtcagtggaacaagccgagtaagccaaaaaccaac

SEQ ID NO: 1178 - DNA, 9 bp, Artificial Sequence
  Synthetic oligonucleotide
atgaagcac

SEQ ID NO: 1179 - DNA, 19 bp, Artificial Sequence
  Synthetic oligonucleotide
atggctggtgctgcagcag

SEQ ID NO: 1180 - DNA, 66 bp, Artificial Sequence
  Synthetic oligonucleotide
ctggggcagtggtggggggccttggcggctacgtgctgggaagtgccatgagcaggcccatcatac

SEQ ID NO: 1181 - DNA, 35 bp, Artificial Sequence
  Synthetic oligonucleotide
atttcggcagtgactatgaggaccgttactatcgt

SEQ ID NO: 1182 - DNA, 24 bp, Artificial Sequence
  Synthetic oligonucleotide
gaaaacatgcaccgttaccccaac

SEQ ID NO: 1183 - DNA, 30 bp, Artificial Sequence
  Synthetic oligonucleotide
caagtgtactacaggcccatggatgagtac

SEQ ID NO: 1184 - DNA, 36 bp, Artificial Sequence
  Synthetic oligonucleotide
agcaaccagaacaactttgtgcacgactgcgtcaat

SEQ ID NO: 1185 - DNA, 26 bp, Artificial Sequence
  Synthetic oligonucleotide
atcacaatcaagcagcacacggtcac

SEQ ID NO: 1186 - DNA, 18 bp, Artificial Sequence
  Synthetic oligonucleotide
gtccatttacctggaaac

SEQ ID NO: 1187 - DNA, 53 bp, Artificial Sequence
  Synthetic oligonucleotide
gtaaaattattccctgaattgtttgatattgtcacctagcagatatgtattac

SEQ ID NO: 1188 - DNA, 9064 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1189 - DNA, 7947 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1190 - DNA, 9197 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1191 - DNA, 9236 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcaggtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1192 - DNA, 9059 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1193 - DNA, 9008 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1194 - DNA, 9450 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1195 - DNA, 7795 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1196 - DNA, 9308 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1197 - DNA, 9910 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaataggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1198 - DNA, 10021 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaataggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1199 - DNA, 8304 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataa

SEQ ID NO: 1200 - DNA, 9342 bp, Homo sapiens
tggaatcttgctttgtcacccaggctggagtgcagtggcaccatcttggctcactgcaacctctgcctcatgggttcaagcaattcttctgcttcagcctcctgggtagctgggatgacaggcacccaccatcatgcccagctaatttttgtatttttgtagagacagggtttcactctgatggccaggctggtcttgaactcctgacctcaggtgatccgcctgtcttggcctccgaaagtgctgagattacagacgtcagccagcagcctatgttagtattttccatggtggattgtacatggtaaataacaaaatatttgctgaattactcaagcttggatgctaatggaaaagaatgaaaggaaaaaaaataatatgggtactttaggtaggaaaggttaattgaatgataacagacacataaagattaggatttgtcaacattatttgcctaaatgtaggtcagaagattaagtgttgaaacttgaccagagctggtatctccttcagtgtttcatcttaaacagatatcttcctatgtgtttatagatacaaatgtgattttgggctttatttttgtgaagtataaatgtagaaattttttttttttaggaagtcaaagtgaattgggcaacaacccctagcagtcaaaagaaagatacaagcagtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcaggtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1201 - DNA, 8967 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1202 - DNA, 8994 bp, Homo sapiens
tcctgggcgaacaagagtgaaactctgtctcaaaaaaaaaaaaaggtaaattgtttctctttgtgtttcagatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcaggtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1203 - DNA, 5959 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1204 - DNA, 8366 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1205 - DNA, 8499 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1206 - DNA, 8372 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagttgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1207 - DNA, 7693 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctacagctggaaatgatccctattgttttgtggagtttcatgagcatcgtcatgcagctgcagcattagctgctatgaatggacggaagataatgggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1208 - DNA, 10073 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacaggtgagagggttcttaactttgagaagtaattgttgggctaataatgttattttaaggtgaagattgttgataatccttgttaataagtttctagctaaaatgatagtatataagggctcttcctacatgtattatagttccagaatggtgtttcatggattgcagtggtgacatgatgaatgtgaccgcctcaattgactcatgctcacacagtggattttaaaatgctccgagaaacctaaaagggtattacatctttttttaatacttggtagatttattcacataccatttggagaactcacaagcatgcttgactcaactgaaacaaaaataaagctgtaaatatagttatggccttggcatttttcttccagattttgctgccttttttttccaggcagctttagtggttcaaacttgattccacaaagatttctatgaggaaactgtaaatggagcacagagatgggagtaagcaaatcctaaactatataagtgtcttaagtaagctgaatatagaaataattaatcacatcttccctatctaaaggaaacaatcatgtagatagtataccaaacacttaaacattctactaagtttaacatttattactagggtatcaactgatgccttccaaaaactatgccattcagagtatcacgtagagttacagcagtataacctcacttgttttgttgttgttttttgtttttttgttttttttttttttttttagcagtcaactcttgtttatcctgtcattttaattgtaatgatggccctgtgtgttttggctaagaatttgtggtatcagcatattaggattgtatatatatagttaacttcaagtaatactaaattttatttaatagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1209 - DNA, 6377 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatctgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1210 - DNA, 9306 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagttccagaatggtgtttcatggattgcagtggtgacatgatgaatgtgaccgcctcaattgactcatgctcacacagtggattttaaaatgctccgagaaacctaaaaggcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1211 - DNA, 6025 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1212 - DNA, 9173 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagttccagaatggtgtttcatggattgcagtggtgacatgatgaatgtgaccgcctcaattgactcatgctcacacagtggattttaaaatgctccgagaaacctaaaaggcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1213 - DNA, 6158 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1214 - DNA, 5569 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaataggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1215 - DNA, 5536 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaataggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1216 - DNA, 9005 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1217 - DNA, 7851 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtg

SEQ ID NO: 1218 - DNA, 7653 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatg

SEQ ID NO: 1219 - DNA, 6826 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttga

SEQ ID NO: 1220 - DNA, 6331 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagt

SEQ ID NO: 1221 - DNA, 5612 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctcc

SEQ ID NO: 1222 - DNA, 6058 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccgtagtttatattcccatggtagtttaaaagtagctaataaaatactgcgtgagccactgcgcccggcaggtaaataatataatcttctataaaatcttctataaatttaaatctataaatttcaacttatgtaaaatttgtgatacgtgcttggctctgttacgcagtgctacagccctgattgccaattacccccagcctctcttcctatgttctacatgctaggaagaccacaatactgattgagcttagcttctctgcctaccccaaaataactgaatgttcctggaaaaaaactgagttcaggtggttttgcttctaatttaatggtcacacactttaggtgagtacagagtactgtcttggcaaacatgtgtttctcatctttcaaccaccaaacttacataaaattcatccaccttcccattcttcctattatagtacaggaaaggtccttcctgtcaaaggcaaaatcacttatgattgtgtccccatctctcttgcccttttcaaggactttgagcctatgctgccactgcttcattgtttttttttttgtttgtttgttttgttttgtttttgttttaacagcagctttattgagatataattcaagtatacagtgtggccgggcacagtggctcacacctgtaatcccagcactttgggagac

SEQ ID NO: 1223 - DNA, 5232 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaaga

SEQ ID NO: 1224 - DNA, 1271 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctcc

SEQ ID NO: 1225 - DNA, 2127 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaaga

SEQ ID NO: 1226 - DNA, 1010 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaaga

SEQ ID NO: 1227 - DNA, 858 bp, Homo sapiens
gccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaaga

SEQ ID NO: 1228 - DNA, 1541 bp, Homo sapiens
ccgggcacagtggtttatgcctataacctcagcactttgggaggctgagaagtttgagataaatactggcaatatagtgggaccctatctctacaaaatatatatattttttattttactttttttttaatttttttttttccgggaattccgaaaattcagccgagcccagtggctcacacctgtaatcccagcactttgggatgccaaggtgggcggatcacttgaggtcaggagttcaagaccaacctggacaacatggcaaaaccccatctctacaaaaaattagccaggcatggcgacacatgcctgtagtcccagctacttgcagggctgaggcgggaggatcacttaaatccaggaggccaaagctgcagtgagtcatgatcaagccactgtactccagcctgggtgacaaagtgaggccctgtctcaagaaaaaaaaagttgaaaattgtaaagtacattgagaggtgaaaacaatacaagctcaatcatgtacatgtcccatctaccaaagattttttttttcctgtaagatgagaaaataaaaattaagagaatttatttggttctcaaaactttactattaagcatagcataatgttttagaaaggtagaaaaataccttctataatggattgatagccgtgattaatttgagttccttagaggattgattcataggttttaggatgttttagtgcaagttagggaaataaattggcggtttgatgggctaggaactcatttttcacattttcgagattgtggactgtagggttctgctatataaaaatcactgttgaatgtgtatttagtatgaactagagtcaaatagcaaaggatgtctcttgataacctgtgtatggcctctggagttagccagagatgtatacaaattctgacaaccattataaaacagatgtaactttgagtaaataatataatcttctataaaatcttctataaatttaaatctataaatttcaacttatgtaaaatttgtgatacgtgcttggctctgttacgcagtgctacagccctgattgccaattacccccagcctctcttcctatgttctacatgctaggaagaccacaatactgattgagcttagcttctctgcctaccccaaaataactgaatgttcctggaaaaaaactgagttcaggtggttttgcttctaatttaatggtcacacactttaggtgagtacagagtactgtcttggcaaacatgtgtttctcatctttcaaccaccaaacttacataaaattcatccaccttcccattcttcctattatagtacaggaaaggtccttcctgtcaaaggcaaaatcacttatgattgtgtccccatctctcttgcccttttcaaggactttgagcctatgctgccactgcttcattgtttttttttttgtttgtttgttttgttttgtttttgttttaacagcagctttattgagatataattcaagtatacagtgtggccgggcacagtggctcacacctgtaatcccagcactttgggagac

SEQ ID NO: 1229 - DNA, 615 bp, Artificial Sequence
  Synthetic oligonucleotide
tggaatcttgctttgtcacccaggctggagtgcagtggcaccatcttggctcactgcaacctctgcctcatgggttcaagcaattcttctgcttcagcctcctgggtagctgggatgacaggcacccaccatcatgcccagctaatttttgtatttttgtagagacagggtttcactctgatggccaggctggtcttgaactcctgacctcaggtgatccgcctgtcttggcctccgaaagtgctgagattacagacgtcagccagcagcctatgttagtattttccatggtggattgtacatggtaaataacaaaatatttgctgaattactcaagcttggatgctaatggaaaagaatgaaaggaaaaaaaataatatgggtactttaggtaggaaaggttaattgaatgataacagacacataaagattaggatttgtcaacattatttgcctaaatgtaggtcagaagattaagtgttgaaacttgaccagagctggtatctccttcagtgtttcatcttaaacagatatcttcctatgtgtttatagatacaaatgtgattttgggctttatttttgtgaagtataaatgtagaaattttttttttttag

SEQ ID NO: 1230 - DNA, 172 bp, Artificial Sequence
  Synthetic oligonucleotide
gtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcag

SEQ ID NO: 1231 - DNA, 596 bp, Artificial Sequence
  Synthetic oligonucleotide
gtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatctgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcag

SEQ ID NO: 1232 - DNA, 521 bp, Artificial Sequence
  Synthetic oligonucleotide
gtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataag

SEQ ID NO: 1233 - DNA, 2166 bp, Artificial Sequence
  Synthetic oligonucleotide
gtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaaccttgggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaag

SEQ ID NO: 1234 - DNA, 175 bp, Artificial Sequence
  Synthetic oligonucleotide
tgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcag

SEQ ID NO: 1235 - DNA, 222 bp, Artificial Sequence
  Synthetic oligonucleotide
gttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaa

SEQ ID NO: 1236 - DNA, 422 bp, Artificial Sequence
  Synthetic oligonucleotide
tttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcag

SEQ ID NO: 1237 - DNA, 324 bp, Artificial Sequence
  Synthetic oligonucleotide
ctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccgtagtttatattcccatggtagtttaaaagtagctaataaaatact

SEQ ID NO: 1238 - DNA, 937 bp, Artificial Sequence
  Synthetic oligonucleotide
ccgggcacagtggtttatgcctataacctcagcactttgggaggctgagaagtttgagataaatactggcaatatagtgggaccctatctctacaaaatatatatattttttattttactttttttttaatttttttttttccgggaattccgaaaattcagccgagcccagtggctcacacctgtaatcccagcactttgggatgccaaggtgggcggatcacttgaggtcaggagttcaagaccaacctggacaacatggcaaaaccccatctctacaaaaaattagccaggcatggcgacacatgcctgtagtcccagctacttgcagggctgaggcgggaggatcacttaaatccaggaggccaaagctgcagtgagtcatgatcaagccactgtactccagcctgggtgacaaagtgaggccctgtctcaagaaaaaaaaagttgaaaattgtaaagtacattgagaggtgaaaacaatacaagctcaatcatgtacatgtcccatctaccaaagattttttttttcctgtaagatgagaaaataaaaattaagagaatttatttggttctcaaaactttactattaagcatagcataatgttttagaaaggtagaaaaataccttctataatggattgatagccgtgattaatttgagttccttagaggattgattcataggttttaggatgttttagtgcaagttagggaaataaattggcggtttgatgggctaggaactcatttttcacattttcgagattgtggactgtagggttctgctatataaaaatcactgttgaatgtgtatttagtatgaactagagtcaaatagcaaaggatgtctcttgataacctgtgtatggcctctggagttagccagagatgtatacaaattctgacaaccattataaaacagatgtaactttga

SEQ ID NO: 1239 - DNA, 604 bp, Artificial Sequence
  Synthetic oligonucleotide
gtaaataatataatcttctataaaatcttctataaatttaaatctataaatttcaacttatgtaaaatttgtgatacgtgcttggctctgttacgcagtgctacagccctgattgccaattacccccagcctctcttcctatgttctacatgctaggaagaccacaatactgattgagcttagcttctctgcctaccccaaaataactgaatgttcctggaaaaaaactgagttcaggtggttttgcttctaatttaatggtcacacactttaggtgagtacagagtactgtcttggcaaacatgtgtttctcatctttcaaccaccaaacttacataaaattcatccaccttcccattcttcctattatagtacaggaaaggtccttcctgtcaaaggcaaaatcacttatgattgtgtccccatctctcttgcccttttcaaggactttgagcctatgctgccactgcttcattgtttttttttttgtttgtttgttttgttttgtttttgttttaacagcagctttattgagatataattcaagtatacagtgtggccgggcacagtggctcacacctgtaatcccagcactttgggagac

SEQ ID NO: 1240 - DNA, 133 bp, Artificial Sequence
  Synthetic oligonucleotide
gtaggtgtattggagaagaaaaggaaatgtggaattttggagaaaaatacgctagattttaaatgttagagctgttcccggagacttattgcagaaatagatgagaagcaaatcaagactactattcaaaaat

SEQ ID NO: 1241 - DNA, 253 bp, Artificial Sequence
  Synthetic oligonucleotide
gtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccag

SEQ ID NO: 1242 - DNA, 713 bp, Artificial Sequence
  Synthetic oligonucleotide
gtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaatag

SEQ ID NO: 1243 - DNA, 124 bp, Artificial Sequence
  Synthetic oligonucleotide
gttcaattcccatgaaagtgcagcacatgcaattgtttctgttaatggtactaccattgaaggtcatgttgtgaaatgctattggggcaaagaaactcttgatatgataaatcccgtgcaacag

SEQ ID NO: 1244 - DNA, 137 bp, Artificial Sequence
  Synthetic oligonucleotide
gtgagagggttcttaactttgagaagtaattgttgggctaataatgttattttaaggtgaagattgttgataatccttgttaataagtttctagctaaaatgatagtatataagggctcttcctacatgtattatag

SEQ ID NO: 1245 - DNA, 630 bp, Artificial Sequence
  Synthetic oligonucleotide
gtattacatctttttttaatacttggtagatttattcacataccatttggagaactcacaagcatgcttgactcaactgaaacaaaaataaagctgtaaatatagttatggccttggcatttttcttccagattttgctgccttttttttccaggcagctttagtggttcaaacttgattccacaaagatttctatgaggaaactgtaaatggagcacagagatgggagtaagcaaatcctaaactatataagtgtcttaagtaagctgaatatagaaataattaatcacatcttccctatctaaaggaaacaatcatgtagatagtataccaaacacttaaacattctactaagtttaacatttattactagggtatcaactgatgccttccaaaaactatgccattcagagtatcacgtagagttacagcagtataacctcacttgttttgttgttgttttttgtttttttgttttttttttttttttttagcagtcaactcttgtttatcctgtcattttaattgtaatgatggccctgtgtgttttggctaagaatttgtggtatcagcatattaggattgtatatatatagttaacttcaagtaatactaaattttatttaatag

SEQ ID NO: 1246 - DNA, 146 bp, Artificial Sequence
  Synthetic oligonucleotide
cagaatcaaattggatatccccaaccttatggccagtggggccagtggtatggaaatgcacaacaaattggccagtatatgcctaatggttggcaagttcctgcatatggaatgtatggccaggcatggaaccagcaaggatttaa

SEQ ID NO: 1247 - DNA, 521 bp, Artificial Sequence
  Synthetic oligonucleotide
tcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaa

SEQ ID NO: 1248 - DNA, 2822 bp, Artificial Sequence
  Synthetic oligonucleotide
aattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgtttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 1249 - DNA, 55 bp, Artificial Sequence
  Synthetic oligonucleotide
gccgggcggcccggaggttgagagtgcaagattattctgcgcctgcgcggcccgg

SEQ ID NO: 1250 - DNA, 87 bp, Artificial Sequence
  Synthetic oligonucleotide
gtaactttgctggctgctcctaggctcccggctcgccgccatcttgtattggggtttcattgttcccgctgggccgggcggtttagt

SEQ ID NO: 1251 - DNA, 96 bp, Artificial Sequence
  Synthetic oligonucleotide
gtaattgccgccggaggaggaggcggagtaacctctggtcagccgagaaaccccactatcctgtagccataaccgcttaaacgatttgggaggtag

SEQ ID NO: 1252 - DNA, 75 bp, Artificial Sequence
  Synthetic oligonucleotide
tgaagggcagggagctggacctggaggcgccgccgcgacagcagcagccatggaggacgagatgcccaagactct

SEQ ID NO: 1253 - DNA, 71 bp, Artificial Sequence
  Synthetic oligonucleotide
tcctgggcgaacaagagtgaaactctgtctcaaaaaaaaaaaaaggtaaattgtttctctttgtgtttcag

SEQ ID NO: 1254 - DNA, 10 bp, Artificial Sequence
  Synthetic oligonucleotide
atacgtcggt

SEQ ID NO: 1255 - DNA, 87 bp, Artificial Sequence
  Synthetic oligonucleotide
aacctttccagagatgtgacagaagctctaattctgcaactctttagccagattggaccttgtaaaaactgcaaaatgattatggat

SEQ ID NO: 1256 - DNA, 4 bp, Artificial Sequence
  Synthetic oligonucleotide
acag

SEQ ID NO: 1257 - DNA, 90 bp, Artificial Sequence
  Synthetic oligonucleotide
ctggaaatgatccctattgttttgtggagtttcatgagcatcgtcatgcagctgcagcattagctgctatgaatggacggaagataatgg

SEQ ID NO: 1258 - DNA, 5 bp, Artificial Sequence
  Synthetic oligonucleotide
gtaag

SEQ ID NO: 1259 - DNA, 55 bp, Artificial Sequence
  Synthetic oligonucleotide
gaagtcaaagtgaattgggcaacaacccctagcagtcaaaagaaagatacaagca

SEQ ID NO: 1260 - DNA, 33 bp, Artificial Sequence
  Synthetic oligonucleotide
gtagtaccgttgtcagcacacagcgttcacaag

SEQ ID NO: 1261 - DNA, 119 bp, Artificial Sequence
  Synthetic oligonucleotide
tcttagttcacttgcacatggattcacataaactgaatggtgtaatgtctgggcaaccaaaactgttggcttttgagaaaactgtcaaatactttaacatcaaactgttgcaatgcaag

SEQ ID NO: 1262 - DNA, 88 bp, Artificial Sequence
  Synthetic oligonucleotide
atcatttccatgtctttgttggtgatctcagcccagaaattacaactgaagatataaaagctgcttttgcaccatttggaagaatatc

SEQ ID NO: 1263 - DNA, 66 bp, Artificial Sequence
  Synthetic oligonucleotide
agtgtctctgaagaatggacagaattgccctggctaactacaagctacggttcacagtggataaat

SEQ ID NO: 1264 - DNA, 54 bp, Artificial Sequence
  Synthetic oligonucleotide
aaaattaaatagtttaattagtttagggaatatacaactttttcattcttttgg

SEQ ID NO: 1265 - DNA, 76 bp, Artificial Sequence
  Synthetic oligonucleotide
agatgcccgagtggtaaaagacatggcaacaggaaagtctaagggatatggctttgtctcctttttcaacaaatgg

SEQ ID NO: 1266 - DNA, 5 bp, Artificial Sequence
  Synthetic oligonucleotide
gtgag

SEQ ID NO: 1267 - DNA, 23 bp, Artificial Sequence
  Synthetic oligonucleotide
gcgtgagccactgcgcccggcag

SEQ ID NO: 1268 - DNA, 61 bp, Artificial Sequence
  Synthetic oligonucleotide
gatgctgaaaacgccattcaacagatgggtggccagtggcttggtggaagacaaatcagaa

SEQ ID NO: 1269 - DNA, 48 bp, Artificial Sequence
  Synthetic oligonucleotide
ctaactgggcaacccgaaagcctcccgctccaaagagtacatatgagt

SEQ ID NO: 1270 - DNA, 96 bp, Artificial Sequence
  Synthetic oligonucleotide
caaataccaaacagctatcatatgatgaggttgtaaatcagtctagtccaagcaactgtactgtatactgtggaggtgttacttctgggctaacag

SEQ ID NO: 1271 - DNA, 111 bp, Artificial Sequence
  Synthetic oligonucleotide
gtatgggagccttccctgtgtggcattaatttttaaagtgcaaagcttaatatttgtaggatttttatataacttagtgtgatttgtttgttttggttttttgtctaacag

SEQ ID NO: 1272 - DNA, 85 bp, Artificial Sequence
  Synthetic oligonucleotide
aacaactaatgcgtcagactttttcaccatttggacaaataatggaaattcgagtctttccagataaaggatattcatttgttcg

SEQ ID NO: 1273 - DNA, 109 bp, Artificial Sequence
  Synthetic oligonucleotide
ttccagaatggtgtttcatggattgcagtggtgacatgatgaatgtgaccgcctcaattgactcatgctcacacagtggattttaaaatgctccgagaaacctaaaagg

SEQ ID NO: 1274 - DNA, 59 bp, Artificial Sequence
  Synthetic oligonucleotide
aaaaaaaaaccaaaactgtgcagagtctagaagttgtttgtcatcttcagcttgtgcac

SEQ ID NO: 1275 - DNA, 777 bp, Homo sapiens
gagacggtgtcccaccgacacgcttttttcttgggaacaggactcccccgactgcctccttgcctggcactggagctctagtttgggggagaagtggtaggtaggagacgagggtgcgaaggccttagccctttggtttggggtctgccgccttcaagaagccggggctttacccctccgggccttccctgcgtaccttatggtacagccgcgagattccgcgctggatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaa

SEQ ID NO: 1276 - DNA, 819 bp, Homo sapiens
gagacggtgtcccaccgacacgcttttttcttgggaacaggactcccccgactgcctccttgcctggcactggagctctagtttgggggagaagtggtaggtaggagacgagggtgcgaaggccttagccctttggtttggggtctgccgccttcaagaagccggggctttacccctccgggccttccctgcgtaccttatggtacagccgcgagattccgcgctgggtacggtcgctgatggcctccaactgctcccgataatacaggatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaa

SEQ ID NO: 1277 - DNA, 598 bp, Homo sapiens
ctgttttgtggagttgagtcttcccaccagcatgttgtctacggttttatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaa

SEQ ID NO: 1278 - DNA, 1165 bp, Homo sapiens
cacgccagcccggaagagacgcagcaccgcgcatgctccttcttttccagccccggtaccggaccctgcagccgcagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacttgccagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtatggttcccacacaaatcccttcagctatttgaagatagtttcttttgtgtaagggacaaaagcattcttagctgatgtcagctttagagggctctggcctgcaggcatttggtcaagtgctagaacctttgtcccatggcttgggacttggaatagaactagactcagttcttcaggccatccatgagatggccttaagcacagatagtctgtcactttcttcacccacacctgtacaaacatccagatacatgtggtatagaatattgagtaacttttcccgcagagtgcgttgtactattcccgagaagtccaaagcaaagccatttaccacctcgaaagaaacaagagtgttgtagttttcttgccaacaggagaagaaattagaaactggagtggagaacggatggtgtataccacgatgtgaaaggatatgcatgcatgtgtggtgtgaggagaattatcttctgattcttgggatcattgctagctcacagttgctttttttttttttttttttttttt

SEQ ID NO: 1279 - DNA, 929 bp, Homo sapiens
cacgccagcccggaagagacgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtatggttcccacacaaatcccttcagctatttgaagatagtttcttttgtgtaagggacaaaagcattcttagctgatgtcagctttagagggctctggcctgcaggcatttggtcaagtgctagaacctttgtcccatggcttgggacttggaatagaactagactcagttcttcaggccatccatgagatggccttaagcacagatagtctgtcactttcttcacccacacctgtacaaacatccagatacatgtggtatagaatattgagtaacttttcccgcagagtgcgttgtactattcccgagaagtccaaagcaaagccatttaccacctcgaaagaaacaagagtgttgtagttttcttgccaacaggagaagaaattagaaactggagtggagaacggatggtgtataccacgatgtgaaaggatatgcatgcatgtgtggtgtgaggagaattatcttctgattcttgggatcattgctagctcacagttgctttttttttttttttttttttttt

SEQ ID NO: 1280 - DNA, 670 bp, Homo sapiens
tgagatcgtaccactgcactccatcctgggtgacagagtaagaccctgtctcaaataagtaaaagaaaactggtgaattttgcacacgtctccatttgaactgtgactgggatataggaccgggcagcatcttgtctgcttttctcccatggtggtaattaaggcttttgtgggcccttccctttacatgttagttcttccataattacactccctttgttatctagatgctgctgtgaagtgggtaagtcagtcagtgtgataggaagtaggaatcctttgggaggatttatagtttgggctgtgagtattgaagggtgacataaggaaggctgagaagggtgccccaggagagacaaaggtggctcagaaggtattccccaccactggtgtaatttgcttatatttaacggagtggtacttggcttttcctgcaagattggagtcagtgagttgtcttcccttgttctatagtagattagatcatatgatgattctaaatcgatgtttcactttctagctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaa

SEQ ID NO: 1281 - DNA, 204 bp, Artificial Sequence
  Synthetic oligonucleotide
gtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggag

SEQ ID NO: 1282 - DNA, 227 bp, Artificial Sequence
  Synthetic oligonucleotide
gagacggtgtcccaccgacacgcttttttcttgggaacaggactcccccgactgcctccttgcctggcactggagctctagtttgggggagaagtggtaggtaggagacgagggtgcgaaggccttagccctttggtttggggtctgccgccttcaagaagccggggctttacccctccgggccttccctgcgtaccttatggtacagccgcgagattccgcgctgg

SEQ ID NO: 1283 - DNA, 528 bp, Artificial Sequence
  Synthetic oligonucleotide
gtatggttcccacacaaatcccttcagctatttgaagatagtttcttttgtgtaagggacaaaagcattcttagctgatgtcagctttagagggctctggcctgcaggcatttggtcaagtgctagaacctttgtcccatggcttgggacttggaatagaactagactcagttcttcaggccatccatgagatggccttaagcacagatagtctgtcactttcttcacccacacctgtacaaacatccagatacatgtggtatagaatattgagtaacttttcccgcagagtgcgttgtactattcccgagaagtccaaagcaaagccatttaccacctcgaaagaaacaagagtgttgtagttttcttgccaacaggagaagaaattagaaactggagtggagaacggatggtgtataccacgatgtgaaaggatatgcatgcatgtgtggtgtgaggagaattatcttctgattcttgggatcattgctagctcacagttgctttttttttttttttttttttttt

SEQ ID NO: 1284 - DNA, 520 bp, Artificial Sequence
  Synthetic oligonucleotide
tgagatcgtaccactgcactccatcctgggtgacagagtaagaccctgtctcaaataagtaaaagaaaactggtgaattttgcacacgtctccatttgaactgtgactgggatataggaccgggcagcatcttgtctgcttttctcccatggtggtaattaaggcttttgtgggcccttccctttacatgttagttcttccataattacactccctttgttatctagatgctgctgtgaagtgggtaagtcagtcagtgtgataggaagtaggaatcctttgggaggatttatagtttgggctgtgagtattgaagggtgacataaggaaggctgagaagggtgccccaggagagacaaaggtggctcagaaggtattccccaccactggtgtaatttgcttatatttaacggagtggtacttggcttttcctgcaagattggagtcagtgagttgtcttcccttgttctatagtagattagatcatatgatgattctaaatcgatgtttcactttctag

SEQ ID NO: 1285 - DNA, 79 bp, Artificial Sequence
  Synthetic oligonucleotide
cacgccagcccggaagagacgcagcaccgcgcatgctccttcttttccagccccggtaccggaccctgcagccgcagag

SEQ ID NO: 1286 - DNA, 32 bp, Artificial Sequence
  Synthetic oligonucleotide
gatgaagccagtgcgtggcggagacttgccag

SEQ ID NO: 1287 - DNA, 42 bp, Artificial Sequence
  Synthetic oligonucleotide
gtacggtcgctgatggcctccaactgctcccgataatacagg

SEQ ID NO: 1288 - DNA, 48 bp, Artificial Sequence
  Synthetic oligonucleotide
ctgttttgtggagttgagtcttcccaccagcatgttgtctacggtttt

SEQ ID NO: 1289 - DNA, 51 bp, Artificial Sequence
  Synthetic oligonucleotide
atgttgatgcctaagaagaaccggattgccatttatgaactcctttttaag

SEQ ID NO: 1290 - DNA, 24 bp, Artificial Sequence
  Synthetic oligonucleotide
gagggagtcatggtggccaagaag

SEQ ID NO: 1291 - DNA, 51 bp, Artificial Sequence
  Synthetic oligonucleotide
gatgtccacatgcctaagcacccggagctggcagacaagaatgtgcccaac

SEQ ID NO: 1292 - DNA, 16 bp, Artificial Sequence
  Synthetic oligonucleotide
cttcatgtcatgaagg

SEQ ID NO: 1293 - DNA, 8 bp, Artificial Sequence
  Synthetic oligonucleotide
ccatgcag

SEQ ID NO: 1294 - DNA, 41 bp, Artificial Sequence
  Synthetic oligonucleotide
tctctcaagtcccgaggctacgtgaaggaacagtttgcctg

SEQ ID NO: 1295 - DNA, 24 bp, Artificial Sequence
  Synthetic oligonucleotide
gagacatttctactggtaccttac

SEQ ID NO: 1296 - DNA, 31 bp, Artificial Sequence
  Synthetic oligonucleotide
caatgagggtatccagtatctccgtgattac

SEQ ID NO: 1297 - DNA, 32 bp, Artificial Sequence
  Synthetic oligonucleotide
cttcatctgcccccggagattgtgcctgccac

SEQ ID NO: 1298 - DNA, 44 bp, Artificial Sequence
  Synthetic oligonucleotide
cctacgccgtagccgtccagagactggcaggcctcggcctaaag

SEQ ID NO: 1299 - DNA, 78 bp, Artificial Sequence
  Synthetic oligonucleotide
gtctggagggtgagcgacctgcgagactcacaagaggggaagctgacagagatacctacagacggagtgctgtgccac

SEQ ID NO: 1300 - DNA, 52 bp, Artificial Sequence
  Synthetic oligonucleotide
ctggtgccgacaagaaagccgaggctggggctgggtcagcaaccgaattcca

SEQ ID NO: 1301 - DNA, 4 bp, Artificial Sequence
  Synthetic oligonucleotide
gttt

SEQ ID NO: 1302 - DNA, 34 bp, Artificial Sequence
  Synthetic oligonucleotide
agaggcggatttggtcgtggacgtggtcagccac

SEQ ID NO: 1303 - DNA, 60 bp, Artificial Sequence
  Synthetic oligonucleotide
ctcagtaaaattggagaggattcttttgcattgaataaacttacagccaaaaaaccttaa

SEQ ID NO: 1304 - DNA, 5601 bp, Homo sapiens
aagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1305 - DNA, 5448 bp, Homo sapiens
aagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1306 - DNA, 4697 bp, Homo sapiens
aagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1307 - DNA, 1896 bp, Homo sapiens
gatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1308 - DNA, 1968 bp, Homo sapiens
cccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1309 - DNA, 2865 bp, Homo sapiens
cccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1310 - DNA, 2720 bp, Homo sapiens
cccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1311 - DNA, 1961 bp, Homo sapiens
cccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1312 - DNA, 170 bp, Artificial Sequence
  Synthetic oligonucleotide
aagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagag

SEQ ID NO: 1313 - DNA, 803 bp, Artificial Sequence
  Synthetic oligonucleotide
gtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcag

SEQ ID NO: 1314 - DNA, 259 bp, Artificial Sequence
  Synthetic oligonucleotide
agaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcag

SEQ ID NO: 1315 - DNA, 185 bp, Artificial Sequence
  Synthetic oligonucleotide
ccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctgg

SEQ ID NO: 1316 - DNA, 839 bp, Artificial Sequence
  Synthetic oligonucleotide
gtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctg

SEQ ID NO: 1317 - DNA, 318 bp, Artificial Sequence
  Synthetic oligonucleotide
gtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactc

SEQ ID NO: 1318 - DNA, 148 bp, Artificial Sequence
  Synthetic oligonucleotide
ctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggag

SEQ ID NO: 1319 - DNA, 305 bp, Artificial Sequence
  Synthetic oligonucleotide
gatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacag

SEQ ID NO: 1320 - DNA, 124 bp, Artificial Sequence
  Synthetic oligonucleotide
cccgaccctcagcagccagcccggcccgcccgcgcccgtccgcagccgcccgccagacgcgcccagtatgagggagatcgtgcacatccaggccggccagtgcggcaaccagatcggggccaag

SEQ ID NO: 1321 - DNA, 253 bp, Artificial Sequence
  Synthetic oligonucleotide
agacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggat

SEQ ID NO: 1322 - DNA, 145 bp, Artificial Sequence
  Synthetic oligonucleotide
gtaagttccccctgctccaagctctgatggcagaccccatcacaggcaagcccaggtcggtggacggggacggctgtgagaaacaaggaatggtcagctcctcacatgatcctgaatggtgggaactcatctctccattttacag

SEQ ID NO: 1323 - DNA, 201 bp, Artificial Sequence
  Synthetic oligonucleotide
ctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgc

SEQ ID NO: 1324 - DNA, 123 bp, Artificial Sequence
  Synthetic oligonucleotide
ctgtgtcctggggcggggccgtggatgccacgttcccacgcctgtgtcctggggcggggccgtggatgccacgttcccacgcctgtgtcctggggcggggccgtggatgccacgttcccatgc

SEQ ID NO: 1325 - DNA, 246 bp, Artificial Sequence
  Synthetic oligonucleotide
cacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgg

SEQ ID NO: 1326 - DNA, 153 bp, Artificial Sequence
  Synthetic oligonucleotide
gtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacag

SEQ ID NO: 1327 - DNA, 124 bp, Artificial Sequence
  Synthetic oligonucleotide
ctacggggacctcaaccacctggtatcggccaccatgagcggagtcaccacctccttgcgcttcccgggccagctcaacgctgacctgcgcaagctggccgtcaacatggtgcccttcccgcgc

SEQ ID NO: 1328 - DNA, 243 bp, Artificial Sequence
  Synthetic oligonucleotide
atgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgag

SEQ ID NO: 1329 - DNA, 230 bp, Artificial Sequence
  Synthetic oligonucleotide
gagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacac

SEQ ID NO: 1330 - DNA, 206 bp, Artificial Sequence
  Synthetic oligonucleotide
cctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttgc

SEQ ID NO: 1331 - DNA, 43 bp, Artificial Sequence
  Synthetic oligonucleotide
atctgggggtgcccagatggaaggaggcaggcatgggggacac

SEQ ID NO: 1332 - DNA, 32 bp, Artificial Sequence
  Synthetic oligonucleotide
ctgccaaccagacaggagcccggtgcctggag

SEQ ID NO: 1333 - DNA, 46 bp, Artificial Sequence
  Synthetic oligonucleotide
ctgggacactccgtctgctccaatgactgagcagcatccaccccac

SEQ ID NO: 1334 - DNA, 17 bp, Artificial Sequence
  Synthetic oligonucleotide
cccatctttgctgccag

SEQ ID NO: 1335 - DNA, 109 bp, Artificial Sequence
  Synthetic oligonucleotide
ttctgggaagtcatcagtgatgagcatggcatcgaccccagcggcaactacgtgggcgactcggacttgcagctggagcggatcagcgtctactacaacgaggcctctt

SEQ ID NO: 1336 - DNA, 93 bp, Artificial Sequence
  Synthetic oligonucleotide
ctcacaagtacgtgcctcgagccattctggtggacctggaacccggaaccatggacagtgtccgctcaggggcctttggacatctcttcaggc

SEQ ID NO: 1337 - DNA, 18 bp, Artificial Sequence
  Synthetic oligonucleotide
ctgacaatttcatctttg

SEQ ID NO: 1338 - DNA, 41 bp, Artificial Sequence
  Synthetic oligonucleotide
ctgtgtcctggggttgggccgtggatgccacgttcccacgt

SEQ ID NO: 1339 - DNA, 39 bp, Artificial Sequence
  Synthetic oligonucleotide
ctgtgtcctggggcggggccgtggatgccacgttcccac

SEQ ID NO: 1340 - DNA, 43 bp, Artificial Sequence
  Synthetic oligonucleotide
gtctgtgtcctggggcggggccgtggatgccacgttcccacgt

SEQ ID NO: 1341 - DNA, 41 bp, Artificial Sequence
  Synthetic oligonucleotide
ctgtgtcctggggcggggccgtggatgccacgttcccatgc

SEQ ID NO: 1342 - DNA, 118 bp, Artificial Sequence
  Synthetic oligonucleotide
ctgtgtcctggggcggggccgtggatgccacgttcccatgtctgtgtcctggggcggggccgtggacgcgccacagaaacaggagggcctcgcttcacttctgccttcccgaccgcag

SEQ ID NO: 1343 - DNA, 43 bp, Artificial Sequence
  Synthetic oligonucleotide
gtcagagtggggccggcaacaactgggccaagggtcactacac

SEQ ID NO: 1344 - DNA, 5 bp, Artificial Sequence
  Synthetic oligonucleotide
ggagg

SEQ ID NO: 1345 - DNA, 23 bp, Artificial Sequence
  Synthetic oligonucleotide
gggcggagctggtggattcggtc

SEQ ID NO: 1346 - DNA, 18 bp, Artificial Sequence
  Synthetic oligonucleotide
ctggatgtggtgcggaag

SEQ ID NO: 1347 - DNA, 57 bp, Artificial Sequence
  Synthetic oligonucleotide
gagtgtgaaaactgcgactgcctgcagggcttccagctgacccactcgctggggggc

SEQ ID NO: 1348 - DNA, 13 bp, Artificial Sequence
  Synthetic oligonucleotide
ggcacgggctccg

SEQ ID NO: 1349 - DNA, 19 bp, Artificial Sequence
  Synthetic oligonucleotide
gcatgggcacgttgctcat

SEQ ID NO: 1350 - DNA, 48 bp, Artificial Sequence
  Synthetic oligonucleotide
cagcaaggtgcgtgaggagtatcccgaccgcatcatgaacaccttcag

SEQ ID NO: 1351 - DNA, 84 bp, Artificial Sequence
  Synthetic oligonucleotide
cgtcgtgccctcacccaaggtgtcagacacggtggtggagccctacaacgccacgctgtccatccaccagctggtggagaacac

SEQ ID NO: 1352 - DNA, 15 bp, Artificial Sequence
  Synthetic oligonucleotide
ggatgagacctactg

SEQ ID NO: 1353 - DNA, 25 bp, Artificial Sequence
  Synthetic oligonucleotide
catcgacaacgaggcgctctacgac

SEQ ID NO: 1354 - DNA, 14 bp, Artificial Sequence
  Synthetic oligonucleotide
atctgcttccgcac

SEQ ID NO: 1355 - DNA, 15 bp, Artificial Sequence
  Synthetic oligonucleotide
cctcaagctggccac

SEQ ID NO: 1356 - DNA, 6 bp, Artificial Sequence
  Synthetic oligonucleotide
gcccac

SEQ ID NO: 1357 - DNA, 37 bp, Artificial Sequence
  Synthetic oligonucleotide
ctgcacttcttcatgcccggcttcgcccccctcacag

SEQ ID NO: 1358 - DNA, 82 bp, Artificial Sequence
  Synthetic oligonucleotide
cccggggcagccagcagtaccgggccctgaccgtgcccgagctcacccagcagatgttcgatgccaagaacatgatggccgc

SEQ ID NO: 1359 - DNA, 55 bp, Artificial Sequence
  Synthetic oligonucleotide
ctgcgacccgcgccacggccgctacctgacggtggccaccgtgttccggggccgc

SEQ ID NO: 1360 - DNA, 9 bp, Artificial Sequence
  Synthetic oligonucleotide
ggcatggac

SEQ ID NO: 1361 - DNA, 2553 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1362 - DNA, 4765 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgatcgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccaccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccaactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaatacatat

SEQ ID NO: 1363 - DNA, 2987 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcggtgggtgagggcagcgggggcggggggcgcaccccggccctgggtctcctcggagcccggtgtgcccgtctgagatgggaaggaagtcgttgcctgctccatggggcctcggggatgaaccccgagacgtagcacccgtgggcacaccacaggggccgaaaatgcagctgtccccgtttccagtctcactcagccaccccgacagggcgcagctctgcccaggccggagtcctttaggggagggatggcagccggggcctggccgtggttttcatgctgccctgcgccaagccacctctgctgagagggaggtttagaacctcagaggtgcccggcggtctgggttagcagtcaggtgggctgagggatgcggagtcagggactcttgcggtgtctctagtccctgcggggcctgacgctgcctccctccccagggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1364 - DNA, 4413 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccaccccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1365 - DNA, 2525 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1366 - DNA, 2518 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggagggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1367 - DNA, 4847 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcggtgggtgagggcagcgggggcggggggcgcaccccggccctgggtctcctcggagcccggtgtgcccgtctgagatgggaaggaagtcgttgcctgctccatggggcctcggggatgaaccccgagacgtagcacccgtgggcacaccacaggggccgaaaatgcagctgtccccgtttccagtctcactcagccaccccgacagggcgcagctctgcccaggccggagtcctttaggggagggatggcagccggggcctggccgtggttttcatgctgccctgcgccaagccacctctgctgagagggaggtttagaacctcagaggtgcccggcggtctgggttagcagtcaggtgggctgagggatgcggagtcagggactcttgcggtgtctctagtccctgcggggcctgacgctgcctccctccccagggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccaccccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1368 - DNA, 2727 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1369 - DNA, 2517 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1370 - DNA, 6799 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccaccccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgatcgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccaccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccaactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaatacatat

SEQ ID NO: 1371 - DNA, 4147 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgatcgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccaccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccaactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaatacatat

SEQ ID NO: 1372 - DNA, 3028 bp, Homo sapiens
caggggcgcgtgcgtcctgccctccctgtgcgcgcgccgccccagcatgccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcggtgggtgagggcagcgggggcggggggcgcaccccggccctgggtctcctcggagcccggtgtgcccgtctgagatgggaaggaagtcgttgcctgctccatggggcctcggggatgaaccccgagacgtagcacccgtgggcacaccacaggggccgaaaatgcagctgtccccgtttccagtctcactcagccaccccgacagggcgcagctctgcccaggccggagtcctttaggggagggatggcagccggggcctggccgtggttttcatgctgccctgcgccaagccacctctgctgagagggaggtttagaacctcagaggtgcccggcggtctgggttagcagtcaggtgggctgagggatgcggagtcagggactcttgcggtgtctctagtccctgcggggcctgacgctgcctccctccccagggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1373 - DNA, 3789 bp, Homo sapiens
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccaccccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcggcctggtctttgttgcactaacacgtctcctctctgggaaacgtcccttgtcaggagacggctcttctttgaaatgaggtcattaaaaggaaacagaaaaa

SEQ ID NO: 1374 - DNA, 1061 bp, Homo sapiens
agggggtcccacctctgaggaccggccgggggctgtagaggtggagtcccccgggtgggagctgggactgtggctccctggctctgcagcctgcagtccgcgcaggctcctgcggggctctggggcgtcggggtctccttggtggctggcaccggcgcctcgcagtctcatctgcctcacctgcccgtagtcccgcagtcacagggctgggctcaaacctgggcctttagggcggcccagagcgcgagcggcttccacattgtccagccggaggctcagccacttctgttcatgggctcagcctgggatttcagtgggggctgatggcgggagccacctcgggagtttggggagttcggggctctgctggcccctcagtgcacacccccgctctgagattctgatgaaaggcacctgcgctctcccacctgtgctgatgcaggcggcccccgggcctccctgggaacctggaaggggttgctccgaggcccccctgggcgagggtgtgcagactcctggggtcctctgccttcctccctgggtccccacccggccacagtgccctgtctcctcggcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaa

SEQ ID NO: 1375 - DNA, 3273 bp, Homo sapiens
agggggtcccacctctgaggaccggccgggggctgtagaggtggagtcccccgggtgggagctgggactgtggctccctggctctgcagcctgcagtccgcgcaggctcctgcggggctctggggcgtcggggtctccttggtggctggcaccggcgcctcgcagtctcatctgcctcacctgcccgtagtcccgcagtcacagggctgggctcaaacctgggcctttagggcggcccagagcgcgagcggcttccacattgtccagccggaggctcagccacttctgttcatgggctcagcctgggatttcagtgggggctgatggcgggagccacctcgggagtttggggagttcggggctctgctggcccctcagtgcacacccccgctctgagattctgatgaaaggcacctgcgctctcccacctgtgctgatgcaggcggcccccgggcctccctgggaacctggaaggggttgctccgaggcccccctgggcgagggtgtgcagactcctggggtcctctgccttcctccctgggtccccacccggccacagtgccctgtctcctcggcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgatcgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccaccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccaactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaatacatat

SEQ ID NO: 1376 - DNA, 1445 bp, Homo sapiens
caggggcgcgtgcgtcctgccctccctgtgcgcgcgccgccccagcatgccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacaggtaagtcccaggcagggtctgtgcgtgggccgcaggtgccgagggaggtggcaccgcaggcgggagtagcccagcccgtggagccggttcagaacctggcttgaagtgtcaccagcaccctgcccctgagcacagggcagcgccacctgctcccaggctggtcgtggtggctaaatcagatggctgggcggaagcgtctggcaggtgctggtcactagaggtgtaaggagagaggcagttcctcccgtgctccgctctgcttcacagcctcgtccattcaaagggactccctggttgtgtgatctgagagccggagatgagaaaatatgtctaaacagcacgcctctccagcctctcccagagccagcagccttgaaccctgaccccgtctggcctctttccctggcccgggaaggcgggtatttgtttctctctgagatgactgaacttggcccccttggcttctgcctcttgcgccctccggcgggggtgacctcatgtcctcgggcgtcctcctcaccctcagcccgatcctcctcctctccttggggtccctgtgctcacggtgaggagtgaggtgcctagtgacaggggttagggacactgcttcccgagctctgcctaaggctgacagtgtacctgcctgaccaagagacccagagagtctccgcagagagctctgagtgaggcaactccccacccttccatctagcggaaggcctttttgctgggaaccatcgagaatccttgagttcaagcccagggcttctctcgtgttccaaggcatcccctgaaagggttggcctccgtggcccatgccatgaggcctccagagggtttgttgtctgggccaggggctggagggagggctgaagctccgcaagcaccccaagcctgcaggtcccgcagcccctgattggaatcctgaccctcttcccactccctctggcttccgacaagtggcttagagcccgtatgacctcggtttcccctcctcggccacgtggtggccc

SEQ ID NO: 1377 - DNA, 143 bp, Artificial Sequence
  Synthetic oligonucleotide
caggggcgcgtgcgtcctgccctccctgtgcgcgcgccgccccagcatgccccgggagcgcgggcggcgggccccttggtcctcaggcggccgtggcggcggtggcggcggttgggccgaggcaggcggcctcagtggccgag

SEQ ID NO: 1378 - DNA, 143 bp, Artificial Sequence
  Synthetic oligonucleotide
cctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacc

SEQ ID NO: 1379 - DNA, 1013 bp, Artificial Sequence
  Synthetic oligonucleotide
gtaagtcccaggcagggtctgtgcgtgggccgcaggtgccgagggaggtggcaccgcaggcgggagtagcccagcccgtggagccggttcagaacctggcttgaagtgtcaccagcaccctgcccctgagcacagggcagcgccacctgctcccaggctggtcgtggtggctaaatcagatggctgggcggaagcgtctggcaggtgctggtcactagaggtgtaaggagagaggcagttcctcccgtgctccgctctgcttcacagcctcgtccattcaaagggactccctggttgtgtgatctgagagccggagatgagaaaatatgtctaaacagcacgcctctccagcctctcccagagccagcagccttgaaccctgaccccgtctggcctctttccctggcccgggaaggcgggtatttgtttctctctgagatgactgaacttggcccccttggcttctgcctcttgcgccctccggcgggggtgacctcatgtcctcgggcgtcctcctcaccctcagcccgatcctcctcctctccttggggtccctgtgctcacggtgaggagtgaggtgcctagtgacaggggttagggacactgcttcccgagctctgcctaaggctgacagtgtacctgcctgaccaagagacccagagagtctccgcagagagctctgagtgaggcaactccccacccttccatctagcggaaggcctttttgctgggaaccatcgagaatccttgagttcaagcccagggcttctctcgtgttccaaggcatcccctgaaagggttggcctccgtggcccatgccatgaggcctccagagggtttgttgtctgggccaggggctggagggagggctgaagctccgcaagcaccccaagcctgcaggtcccgcagcccctgattggaatcctgaccctcttcccactccctctggcttccgacaagtggcttagagcccgtatgacctcggtttcccctcctcggccacgtggtggccc

SEQ ID NO: 1380 - DNA, 161 bp, Artificial Sequence
  Synthetic oligonucleotide
gagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggag

SEQ ID NO: 1381 - DNA, 912 bp, Artificial Sequence
  Synthetic oligonucleotide
ggtaccaatgggggtacaggtgggcaccgatcactgcaaggcaggggggtgctcctcgctgttcagggaccgggaactcagtctgctcgtgattaggctgtggcctgctcgctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcagagcccgtgagactgggaaccaaggcctggacatggaggtgtccccacatgcagcagtgatgccctcggaggctcctcggacagccctggtccccataccacgttccgtgtgaggccttagagtcatctgcaccccttctggttccaaaaaggccttgggattatgataacgctggtggcatgaccagaggagttgtgtagtaacacaggccgagaggtgcagggaccggaggtcagacggagctggatatgagcctttggccctgggacagggcgtgctggccctggaggtggagggagtggcgcccctgggtgacagtgtggtggtgtcggttgcag

SEQ ID NO: 1382 - DNA, 136 bp, Artificial Sequence
  Synthetic oligonucleotide
gagaactgcgctatcctcaaggagctggtgacgctgcgggcccagaagtcccgcctgctggggttccacacgcacgccgactatgtcctggagatgaacatggccaagaccagccagaccgtggccaccttcctag

SEQ ID NO: 1383 - DNA, 294 bp, Artificial Sequence
  Synthetic oligonucleotide
gagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggag

SEQ ID NO: 1384 - DNA, 434 bp, Artificial Sequence
  Synthetic oligonucleotide
gtgggtgagggcagcgggggcggggggcgcaccccggccctgggtctcctcggagcccggtgtgcccgtctgagatgggaaggaagtcgttgcctgctccatggggcctcggggatgaaccccgagacgtagcacccgtgggcacaccacaggggccgaaaatgcagctgtccccgtttccagtctcactcagccaccccgacagggcgcagctctgcccaggccggagtcctttaggggagggatggcagccggggcctggccgtggttttcatgctgccctgcgccaagccacctctgctgagagggaggtttagaacctcagaggtgcccggcggtctgggttagcagtcaggtgggctgagggatgcggagtcagggactcttgcggtgtctctagtccctgcggggcctgacgctgcctccctccccag

SEQ ID NO: 1385 - DNA, 183 bp, Artificial Sequence
  Synthetic oligonucleotide
gcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccag

SEQ ID NO: 1386 - DNA, 1860 bp, Artificial Sequence
  Synthetic oligonucleotide
gtgggtgcgggcccgggcaggggcaggggcaggggcaggggcaggggctgcctgtggtcagcgaggcccaagcctggggcttcggcttccggctctctctgcacccgtccggtggctccttcatccaatgccaccccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcag

SEQ ID NO: 1387 - DNA, 187 bp, Artificial Sequence
  Synthetic oligonucleotide
gcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacag

SEQ ID NO: 1388 - DNA, 174 bp, Artificial Sequence
  Synthetic oligonucleotide
tttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcag

SEQ ID NO: 1389 - DNA, 578 bp, Artificial Sequence
  Synthetic oligonucleotide
agggggtcccacctctgaggaccggccgggggctgtagaggtggagtcccccgggtgggagctgggactgtggctccctggctctgcagcctgcagtccgcgcaggctcctgcggggctctggggcgtcggggtctccttggtggctggcaccggcgcctcgcagtctcatctgcctcacctgcccgtagtcccgcagtcacagggctgggctcaaacctgggcctttagggcggcccagagcgcgagcggcttccacattgtccagccggaggctcagccacttctgttcatgggctcagcctgggatttcagtgggggctgatggcgggagccacctcgggagtttggggagttcggggctctgctggcccctcagtgcacacccccgctctgagattctgatgaaaggcacctgcgctctcccacctgtgctgatgcaggcggcccccgggcctccctgggaacctggaaggggttgctccgaggcccccctgggcgagggtgtgcagactcctggggtcctctgccttcctccctgggtccccacccggccacagtgccctgtctcctcggcag

SEQ ID NO: 1390 - DNA, 134 bp, Artificial Sequence
  Synthetic oligonucleotide
gttggcatggattacagaagctgcatcctgagacccggcggttccgaggatgccagcgccatgctgaggcgcttcctgggccgtgaccccaagcaggacgccttcctcctgagcaaggggctgcaggtcggggg

SEQ ID NO: 1391 - DNA, 190 bp, Artificial Sequence
  Synthetic oligonucleotide
ctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccag

SEQ ID NO: 1392 - DNA, 2314 bp, Artificial Sequence
  Synthetic oligonucleotide
ggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgatcgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccaccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccaactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaatacatat

SEQ ID NO: 1393 - DNA, 76 bp, Artificial Sequence
  Synthetic oligonucleotide
gtggctggacgcgtagcaggtggaaggagggagggagccgcaggcgcagacccacccgccatgaagccccccgcag

SEQ ID NO: 1394 - DNA, 12 bp, Artificial Sequence
  Synthetic oligonucleotide
caggagtttgag

SEQ ID NO: 1395 - DNA, 58 bp, Artificial Sequence
  Synthetic oligonucleotide
gacgtgtcctacgagagcacgctcaaggcgctggccgatgtggaggtcacctacacag

SEQ ID NO: 1396 - DNA, 29 bp, Artificial Sequence
  Synthetic oligonucleotide
ttcagaggaatatccttgacttcccccag

SEQ ID NO: 1397 - DNA, 35 bp, Artificial Sequence
  Synthetic oligonucleotide
catgtttccccctccaaggacatccggacagccag

SEQ ID NO: 1398 - DNA, 45 bp, Artificial Sequence
  Synthetic oligonucleotide
cacagaggccgacaagaagctctctgagttcgacgtggagatgag

SEQ ID NO: 1399 - DNA, 40 bp, Artificial Sequence
  Synthetic oligonucleotide
catgagggaggacgtgtaccagaggatcgtgtggctccag

SEQ ID NO: 1400 - DNA, 71 bp, Artificial Sequence
  Synthetic oligonucleotide
gagaaagttcagaaggactcactgaggcccgaggctgcgcggtacctggagcggctaatcaagctgggccg

SEQ ID NO: 1401 - DNA, 25 bp, Artificial Sequence
  Synthetic oligonucleotide
gagaaatgggcttcacctccccaga

SEQ ID NO: 1402 - DNA, 12 bp, Artificial Sequence
  Synthetic oligonucleotide
gagactcaggaa

SEQ ID NO: 1403 - DNA, 103 bp, Artificial Sequence
  Synthetic oligonucleotide
aacatcaaacgcatcaagaagaagctgagccttctgtgcatcgacttcaacaagaacctgaacgaggacacgaccttcctgcccttcacgctccaggagctag

SEQ ID NO: 1404 - DNA, 38 bp, Artificial Sequence
  Synthetic oligonucleotide
atgagctggcgcagaagctgaagcccctgggggagcag

SEQ ID NO: 1405 - DNA, 7 bp, Artificial Sequence
  Synthetic oligonucleotide
gtggtcg

SEQ ID NO: 1406 - DNA, 28 bp, Artificial Sequence
  Synthetic oligonucleotide
gcaagttctacctggacctgtacccgcg

SEQ ID NO: 1407 - DNA, 19 bp, Artificial Sequence
  Synthetic oligonucleotide
ggaaggaaagtacgggcac

SEQ ID NO: 1408 - DNA, 23 bp, Artificial Sequence
  Synthetic oligonucleotide
gcctcttcaacctgcgccagatc

SEQ ID NO: 1409 - DNA, 6 bp, Artificial Sequence
  Synthetic oligonucleotide
gtcctc

SEQ ID NO: 1410 - DNA, 100 bp, Artificial Sequence
  Synthetic oligonucleotide
gccaaggtggaccaggccctgcacacgcagacggacgcagaccccgccgaggagtatgcgcggctctgccaggagatcctcggggtcccggccacgccag

SEQ ID NO: 1411 - DNA, 36 bp, Artificial Sequence
  Synthetic oligonucleotide
gaaccaacatgcctgcaaccttcggccatctggcag

SEQ ID NO: 1412 - DNA, 101 bp, Artificial Sequence
  Synthetic oligonucleotide
gtggctacgacgcccagtactacgggtacctgtggagcgaggtgtattccatggacatgttccacacgcgcttcaagcaggagggtgtcctgaacagcaag

SEQ ID NO: 1413 - DNA, 57 bp, Artificial Sequence
  Synthetic oligonucleotide
ctgcgagcccgagccgcaggtctgctgaggcctggcactgcgactgcccagtctggc

SEQ ID NO: 1414 - DNA, 2839 bp, Homo sapiens
ggtggagacctcccagaaagggctaggctggaatcaaactccccagggagaggtctggggagatgggacaagcccctcgaagcccccttcccttcattctggacttgtcttcccccacctggcctcacccctttatagaagataaaaaggcccagtgcctccatttgtctggacacttatggagaggggaggacttgggttgggaagagcaagccaagtggccccgggctggcatcactgctcatgtgtcctcttcacaactcaacttgaggtttcgctgccttagccttctcctgtgacctgcttgtatggggagagcagtgtgggagtgggacggcctaggcctgtcgtctgccattgcttacctgctgggctcacccggggccggtcactcagcccctccaagtctgtttcctcacctgcaaagtggggatcatggtctctacttcccagaccatcctgagccatgataagtaaccagtgccaaaagccttttgcccagggcctgtctctggccaaggccaggccgccaactggatgacagcattacctggacctgtcttgccctgtcctgtgttgtgtctgaaccgtggtccccttgaggacgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 1415 - DNA, 647 bp, Artificial Sequence
  Synthetic oligonucleotide
ggtggagacctcccagaaagggctaggctggaatcaaactccccagggagaggtctggggagatgggacaagcccctcgaagcccccttcccttcattctggacttgtcttcccccacctggcctcacccctttatagaagataaaaaggcccagtgcctccatttgtctggacacttatggagaggggaggacttgggttgggaagagcaagccaagtggccccgggctggcatcactgctcatgtgtcctcttcacaactcaacttgaggtttcgctgccttagccttctcctgtgacctgcttgtatggggagagcagtgtgggagtgggacggcctaggcctgtcgtctgccattgcttacctgctgggctcacccggggccggtcactcagcccctccaagtctgtttcctcacctgcaaagtggggatcatggtctctacttcccagaccatcctgagccatgataagtaaccagtgccaaaagccttttgcccagggcctgtctctggccaaggccaggccgccaactggatgacagcattacctggacctgtcttgccctgtcctgtgttgtgtctgaaccgtggtccccttgaggacgtgactgaaactatctggtagatgactgtctccctccctag

SEQ ID NO: 1416 - DNA, 170 bp, Artificial Sequence
  Synthetic oligonucleotide
gggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactg

SEQ ID NO: 1417 - DNA, 201 bp, Artificial Sequence
  Synthetic oligonucleotide
gtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcag

SEQ ID NO: 1418 - DNA, 131 bp, Artificial Sequence
  Synthetic oligonucleotide
ctgcacgccggcgtcgtgcccgacctgctctgggctgcccaccacgcctgtccccgggactgagctgccatgccagcctgcccacagcagcctcctagagttagcaacaccaggtgttcctcccaactcgt

SEQ ID NO: 1419 - DNA, 138 bp, Artificial Sequence
  Synthetic oligonucleotide
ctcttccacccacgccgtggcgctccaacttccttccctgccttttccctccaagctcctattttactgtgtcagctggaaggaaacctttccctcttgggacctctttaccctctgtgacctgtggggttagaccag

SEQ ID NO: 1420 - DNA, 405 bp, Artificial Sequence
  Synthetic oligonucleotide
atcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagg

SEQ ID NO: 1421 - DNA, 205 bp, Artificial Sequence
  Synthetic oligonucleotide
gtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctc

SEQ ID NO: 1422 - DNA, 244 bp, Artificial Sequence
  Synthetic oligonucleotide
cccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggc

SEQ ID NO: 1423 - DNA, 117 bp, Artificial Sequence
  Synthetic oligonucleotide
ggctggccctgctgggcttcctggtgctggtgccaatgaccatgccctggggtcagctgggcaaggatggctggctgggaggcacacattgcgtggcctgccttgcaccccctgcag

SEQ ID NO: 1424 - DNA, 105 bp, Artificial Sequence
  Synthetic oligonucleotide
gctccgtgctctatcacctctttatgtgccaccaagggggcagcgctgtgtacgcccggctcctcgccctggacatgtgtggggtctgccttgtcaacacccttg

SEQ ID NO: 1425 - DNA, 87 bp, Artificial Sequence
  Synthetic oligonucleotide
ctgcaaggggctggctccttggatgcttccagctcatgagatgtctcagcaggagccctgttcacccgttcttccctgtggactgac

SEQ ID NO: 1426 - DNA, 4 bp, Artificial Sequence
  Synthetic oligonucleotide
agag

SEQ ID NO: 1427 - DNA, 119 bp, Artificial Sequence
  Synthetic oligonucleotide
ggactctggggtcacgtcttgctctgagagttcaagtcctgccaggccgccagcccagagcctcctcaccctatcctgttcctcccaccaggcctgtggccagtcttcctgatctccat

SEQ ID NO: 1428 - DNA, 9 bp, Artificial Sequence
  Synthetic oligonucleotide
ctttctgcc

SEQ ID NO: 1429 - DNA, 40 bp, Artificial Sequence
  Synthetic oligonucleotide
ctgcataccagccctcccagcagccacaagcttgcccgcc

SEQ ID NO: 1430 - DNA, 20 bp, Artificial Sequence
  Synthetic oligonucleotide
ctggctccctctgcccagag

SEQ ID NO: 1431 - DNA, 80 bp, Artificial Sequence
  Synthetic oligonucleotide
actatggagtaaggcattcaggacaaaaggaccaagggggcgtggacccgtcttgtaccagctggccacaggcacaaggg

SEQ ID NO: 1432 - DNA, 12 bp, Artificial Sequence
  Synthetic oligonucleotide
ctgcagctgctt

SEQ ID NO: 1433 - DNA, 38 bp, Artificial Sequence
  Synthetic oligonucleotide
cttccaggaaactgacacagggagctcagcggcctcag

SEQ ID NO: 1434 - DNA, 67 bp, Artificial Sequence
  Synthetic oligonucleotide
cccctctgtccttttcagaacacatggacttggaggcagatttgaaataaacttttagtaaatgtaa

SEQ ID NO: 1435 - DNA, 1351 bp, Homo sapiens
ttggcgagttcccgcgcctggaattggttttcccgcgtctgggggtctggcctcctggagaggccggcggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcag

SEQ ID NO: 1436 - DNA, 1157 bp, Homo sapiens
cggcaggattgggggagtgcggggagggggaatcacccagcaggctgcaggaccccaagcctggtgggcctagagaggagaggaccgtggctgataactctaagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcag

SEQ ID NO: 1437 - DNA, 1436 bp, Homo sapiens
ttggcgagttcccgcgcctggaattggttttcccgcgtctgggggtctggcctcctggagaggccggcggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacaggatcagagaagcaaggacttctgctttctccgttgtaaagttttgttctctggtttgttttctcaccctggcctggccaccccagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcag

SEQ ID NO: 1438 - DNA, 1259 bp, Homo sapiens
ttggcgagttcccgcgcctggaattggttttcccgcgtctgggggtctggcctcctggagaggccggcggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcag

SEQ ID NO: 1439 - DNA, 792 bp, Homo sapiens
ggcaggcaggccacggagatacctcgtggaaggaggaacagcaagtgcatgggccgagtgtgggacttgcctggtgtgctcaaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcag

SEQ ID NO: 1440 - DNA, 298 bp, Artificial Sequence
  Synthetic oligonucleotide
ttggcgagttcccgcgcctggaattggttttcccgcgtctgggggtctggcctcctggagaggccggcggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcag

SEQ ID NO: 1441 - DNA, 708 bp, Artificial Sequence
  Synthetic oligonucleotide
gtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcag

SEQ ID NO: 1442 - DNA, 104 bp, Artificial Sequence
  Synthetic oligonucleotide
cggcaggattgggggagtgcggggagggggaatcacccagcaggctgcaggaccccaagcctggtgggcctagagaggagaggaccgtggctgataactctaag

SEQ ID NO: 1443 - DNA, 80 bp, Artificial Sequence
  Synthetic oligonucleotide
ctggtgggcacggaggatgctcttctgcagcagctggcggactcgatgctcaaagaggactgcgcctccgagctgaaggt

SEQ ID NO: 1444 - DNA, 93 bp, Artificial Sequence
  Synthetic oligonucleotide
ccacttggcaaagtccctccctttgccctccagtgtgaatcggccccgaattgacctgatcgtgtttgtggttaatcttcacagcaaatacag

SEQ ID NO: 1445 - DNA, 77 bp, Artificial Sequence
  Synthetic oligonucleotide
gatcagagaagcaaggacttctgctttctccgttgtaaagttttgttctctggtttgttttctcaccctggcctggc

SEQ ID NO: 1446 - DNA, 8 bp, Artificial Sequence
  Synthetic oligonucleotide
caccccag

SEQ ID NO: 1447 - DNA, 80 bp, Artificial Sequence
  Synthetic oligonucleotide
tctccagaacacagaggagtccctgcgccatgtggatgccagcttcttcttggggaaggtgtgtttcctcgccacaggtg

SEQ ID NO: 1448 - DNA, 17 bp, Artificial Sequence
  Synthetic oligonucleotide
ctgggcgggagagccac

SEQ ID NO: 1449 - DNA, 75 bp, Artificial Sequence
  Synthetic oligonucleotide
tgcagcattcaccggcacaccgtggtgaagctggcccacacctatcaaagccccctgctctactgtgacctggag

SEQ ID NO: 1450 - DNA, 84 bp, Artificial Sequence
  Synthetic oligonucleotide
ggcaggcaggccacggagatacctcgtggaaggaggaacagcaagtgcatgggccgagtgtgggacttgcctggtgtgctcaag

SEQ ID NO: 1451 - DNA, 4133 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1452 - DNA, 6279 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctcaaaaaaaaaaaaaaaaaagaaggcaatatctgtgcattctttttaagcatttatttatagagagcataggctttaaaacagacccagtttgaaatcctagaccctctacttacctgctatttaacattaggaaaataacttcttatgtcaagatttttcattaacaaaatgaaggattataatacctacatcacaggcttgttaaaagcatgagatgagagagaatctttgaaaatcatctaacaggctgggcacggtggctcacgcctgtaatcccagcactttgggaggccgaggcgggcagatcacgaggtcaggagatcgagaccatcctaacacagtgaaaccccgtctctactaaaaaaaatacaaaaaattagccgggcgtggctgtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1453 - DNA, 4272 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggagttttgctcttgtcatccacgctggaatgcaatggtgcgatctcggctcgctgcagcctccgcctcccagcttcaagcgattctcctgactcagcctcccaagtagctgggactacaggcatgccccaccattcccagatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1454 - DNA, 4157 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttttgaattgtatacactataggtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1455 - DNA, 4135 bp, Homo sapiens
agacggggtttcaccgtgttggccaggatggtcctgatctcttgaccttgtaatctgcccgccttggcctcccaaagtgctgggattacaggcatgagccaccgcgcccagccagctctactgctttttagctatgtgacctcaggtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1456 - DNA, 4349 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaactaagctaccctctgtacagaatctgccctcagccatccttcacccatgctgggcctcaactccccctggacaggatggtttacctaacttactgccgttgtttgtacagcctgactttgaaaccaaaagttggctaaggagaagaatgtcatgtcctccacctgtcctcaagctgatcagtgcatcacccttcatccactacactaagtgtagaggtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1457 - DNA, 4239 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaacctgactttgaaaccaaaagttggctaaggagaagaatgtcatgtcctccacctgtcctcaagctgatcagtgcatcacccttcatccactacactaagtgtagaggtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1458 - DNA, 4157 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctcaaaaaaaaaaaaaaaaaagaaggcaatatctgtgcattctttttaagcatttatttatagagagcataggctttaaaacagacccagtttgaaatcctagaccctctacttacctgctatttaacattaggaaaataacttcttatgtcaagatttttcattaacaaaatgaaggattataatacctacatcacaggcttgttaaaagcatgagatgagagagaatctttgaaaatcatctaacaggctgggcacggtggctcacgcctgtaatcccagcactttgggaggccgaggcgggcagatcacgaggtcaggagatcgagaccatcctaacacagtgaaaccccgtctctactaaaaaaaatacaaaaaattagccgggcgtggctgtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggtgaggattcctcaggaacattctgattttcttcaaattcttaggcaggtaccctggtcttcaacttaagattctagctagatggtttccgaaaagcaaaagtctatccttttggaatgcttaggagtgagtgtgtgtgtacatgtattagtctgttctcacactgctataaagaaatacctgagactggataatttaatttaaaaaagaggtttaattggctcacagttctgcgggctgtacaggaagctgagcagcttccacttctgcgaatgcctcaggaaacttaaattcacagtggaaggtgaaggagaagtagccatgtcttacatggcccagcccaagcaagagagaaagggggaaggtgctacacacttttaaaacaaccaggtcttgtgataactcactcactatcacgagaacagcaccaaggggaatggtgttaaaccgtttatgagaaaccgtccccatgatccagttgccttccactaggccccaccttcaacattggggattacaattcaac

SEQ ID NO: 1459 - DNA, 3900 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctcaaaaaaaaaaaaaaaaaagaaggcaatatctgtgcattctttttaagcatttatttatagagagcataggctttaaaacagacccagtttgaaatcctagaccctctacttacctgctatttaacattaggaaaataacttcttatgtcaagatttttcattaacaaaatgaaggattataatacctacatcacaggcttgttaaaagcatgagatgagagagaatctttgaaaatcatctaacaggctgggcacggtggctcacgcctgtaatcccagcactttgggaggccgaggcgggcagatcacgaggtcaggagatcgagaccatcctaacacagtgaaaccccgtctctactaaaaaaaatacaaaaaattagccgggcgtggctgtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtaagatggctgggttattttatttttaaggtagttgtcgcaaacatttgaaaagttcacttattagtgacaaaaaagttaatgcttgagataatgttagtgattcagaaaagttcatcagtgaatcattttacctttgtcattttagacttgtacttacactatttgtcataaatatttgtgtatgtttggtttgcttctcaggactgtgaataactcgaagggatagtatcttgttgtcatatgctcagtcccgctaatgtagagctcaataaatgtttgaatgaatgaatgagggagtgaacaattggagtttctttcttggttcttttcttttcttctctctccatgaccagtccatcagtcaaaaggcagatggggaaaagaaaccattaagggcaactccctaaactttagtattggtgacaaaaatgtgaatctaaataagccaggcatggtggcgcatacctgtaatctaagctactcaggaggccgaggcaggagaatcacttgacaagggaggcagaacttgcagtgagccgagattacaccactgcactccagcctaggtgacagagtgagactccatctca

SEQ ID NO: 1460 - DNA, 3698 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctcaaaaaaaaaaaaaaaaaagaaggcaatatctgtgcattctttttaagcatttatttatagagagcataggctttaaaacagacccagtttgaaatcctagaccctctacttacctgctatttaacattaggaaaataacttcttatgtcaagatttttcattaacaaaatgaaggattataatacctacatcacaggcttgttaaaagcatgagatgagagagaatctttgaaaatcatctaacaggctgggcacggtggctcacgcctgtaatcccagcactttgggaggccgaggcgggcagatcacgaggtcaggagatcgagaccatcctaacacagtgaaaccccgtctctactaaaaaaaatacaaaaaattagccgggcgtggctgtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagagtaagacaactcatttaggaattttcttcattcttgaaacctcaagtaacatgtctcttatcaggtcttataagtcaaggtatttagtaaagaaacaaaatctttatgatttgaattagaaaagacctgtttatggcacttttgggtcctggtattcaaaaacaaaagaaatgttggtactttagctaaatgattggtacagattacaggcagtcctccatatctgtgggttttgcaaccttggattcaaccaaacacaaatcaaaaatattc

SEQ ID NO: 1461 - DNA, 3574 bp, Homo sapiens
tacagtgggttcttaaatgctcaatgagtgtcagaagcaaataatatactcagaagatgaaattttcacataaaatgaaagttttactaaggtatcttgcttcacttcgtcatcagatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcgtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1462 - DNA, 2669 bp, Homo sapiens
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1463 - DNA, 4618 bp, Homo sapiens
acttttattttgaaaaattttaaacccacagaaaagctgaaaaagtggtataatgaatgctgatatgcccttcacctggatgtaatcttgttaacattatatttgctttgcccttctcttcctctttctacacacccacactcaccacacaaacaactttgtttttacctgaatcatttgaaagtttcagatgtcatgacacttcacccctaaattcttttgtacaaatcttataaggataaattttcctacagaaccacaattccattgtcatacctaagaaaactaacatgattgaagaataatttaaatatggtttatattcaaattttctcagttctaccaaaagtgtcttttataagttgtctttcctcctgatatattacattggtttatggtatctttttaaaatctagaacaatcaccccacctctcttttttctttaaaaccacatcaggctatgctataatttttgtttcaatcatcaaacataatgtagaaaacttaagaggaaaaggaaagtctattacatttacctatacttttgcttactgtgttcattcttccttcctgaagtaccaagattctttattttgtcacttctgtttagagaaatttctttagcctttcttttagggtaggtctgctgatgaaaaattatcatagctttccttttgagaatgtgttgatttccctttgatttttaaaggttatttttgctggatgtagaactctggttcaacagttcttatctttagcacttaaaaaatgttaagagcccagtccacttgtgctgtaagatgtcccatccataatcaggatttgtcagattgcttcctcatgattgggttgagttaaacatttttggtagaagtactacataatcttcatgtcaggaaacagttaatatcagtttgtctcacttttggaaaccaagttgatcacttcgctaaggaagtaactgctagatgtttccttataaaaaggtacatttttccttttatcatttttttaagcaatttctggagtaatattttgagaccatgtgaatatcctattttccaattatcttgaacccagttttagcattcattgatcatccttgaaatattagctagagaattacaaaattctggctttactaaatctgtcattccttctacatttattagctagcagtattctctaaagaagagccttcctttttttctttaattcaatgtattataagcaattactgtcagtattgtttttgatggtcaaattgccttaaatttggccaataagagccccttcaagttatatgtatcctttaaaactgtccccattttaatttttgaaaacttgttttattgtataacaagatggtctgggattttgtactttctctgcccaaacctggaattaaaactaccctgagctaatttctcatctaatggattgccaaaaattcaaaaactgaacaacacactctgtctgcaaggctataggtggaagttcaaaatggtacaacttctttgcaggggaattttgcaatatctaattacatatgcatttgtcgtttgatgaagcaatctcctcctcatctaagaagatttcaagaataccaaaaaaatacatacacaaagtaattctctggggcattgtataaaatagctaaatattgaaaacaatctaaatacccaaccacagaagactggtttactcaattatggtaaaaccaagtaatggagtactatacagcaataagaaatgaatgaagaaggtttctgtgaactgatacagaatgatttccaagatatattgttaagtaaacaaaacgtagtacaaaagcattatatagcataatatttttggttgttttttaaaccttatcctgtattgtacttattagcactggaaagtggaagaggtctctgctaattagggtggagaattaatcacctactgggtttccttcttttcccaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1464 - DNA, 2552 bp, Homo sapiens
acttttattttgaaaaattttaaacccacagaaaagctgaaaaagtggtataatgaatgctgatatgcccttcacctggatgtaatcttgttaacattatatttgctttgcccttctcttcctctttctacacacccacactcaccacacaaacaactttgtttttacctgaatcatttgaaagtttcagatgtcatgacacttcacccctaaattcttttgtacaaatcttataaggataaattttcctacagaaccacaattccattgtcatacctaagaaaactaacatgattgaagaataatttaaatatggtttatattcaaattttctcagttctaccaaaagtgtcttttataagttgtctttcctcctgatatattacattggtttatggtatctttttaaaatctagaacaatcaccccacctctcttttttctttaaaaccacatcaggctatgctataatttttgtttcaatcatcaaacataatgtagaaaacttaagaggaaaaggaaagtctattacatttacctatacttttgcttactgtgttcattcttccttcctgaagtaccaagattctttattttgtcacttctgtttagagaaatttctttagcctttcttttagggtaggtctgctgatgaaaaattatcatagctttccttttgagaatgtgttgatttccctttgatttttaaaggttatttttgctggatgtagaactctggttcaacagttcttatctttagcacttaaaaaatgttaagagcccagtccacttgtgctgtaagatgtcccatccataatcaggatttgtcagattgcttcctcatgattgggttgagttaaacatttttggtagaagtactacataatcttcatgtcaggaaacagttaatatcagtttgtctcacttttggaaaccaagttgatcacttcgctaaggaagtaactgctagatgtttccttataaaaaggtacatttttccttttatcatttttttaagcaatttctggagtaatattttgagaccatgtgaatatcctattttccaattatcttgaacccagttttagcattcattgatcatccttgaaatattagctagagaattacaaaattctggctttactaaatctgtcattccttctacatttattagctagcagtattctctaaagaagagccttcctttttttctttaattcaatgtattataagcaattactgtcagtattgtttttgatggtcaaattgccttaaatttggccaataagagccccttcaagttatatgtatcctttaaaactgtccccattttaatttttgaaaacttgttttattgtataacaagatggtctgggattttgtactttctctgcccaaacctggaattaaaactaccctgagctaatttctcatctaatggattgccaaaaattcaaaaactgaacaacacactctgtctgcaaggctataggtggaagttcaaaatggtacaacttctttgcaggggaattttgcaatatctaattacatatgcatttgtcgtttgatgaagcaatctcctcctcatctaagaagatttcaagaataccaaaaaaatacatacacaaagtaattctctggggcattgtataaaatagctaaatattgaaaacaatctaaatacccaaccacagaagactggtttactcaattatggtaaaaccaagtaatggagtactatacagcaataagaaatgaatgaagaaggtttctgtgaactgatacagaatgatttccaagatatattgttaagtaaacaaaacgtagtacaaaagcattatatagcataatatttttggttgttttttaaaccttatcctgtattgtacttattagcactggaaagtggaagaggtctctgctaattagggtggagaattaatcacctactgggtttccttcttttcccaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctata

SEQ ID NO: 1465 - DNA, 143 bp, Artificial Sequence
  Synthetic oligonucleotide
ggtgttgaagggctcagtgacaattaaagatggctgcgcccatgtaacatcactagcgaccggtgacctctttttcccccttgcctggctcctgtggtggcaggctgggcacgaggaccatgctgggccggagcctccgagaa

SEQ ID NO: 1466 - DNA, 145 bp, Artificial Sequence
  Synthetic oligonucleotide
agacggggtttcaccgtgttggccaggatggtcctgatctcttgaccttgtaatctgcccgccttggcctcccaaagtgctgggattacaggcatgagccaccgcgcccagccagctctactgctttttagctatgtgacctcag

SEQ ID NO: 1467 - DNA, 160 bp, Artificial Sequence
  Synthetic oligonucleotide
gtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatg

SEQ ID NO: 1468 - DNA, 139 bp, Artificial Sequence
  Synthetic oligonucleotide
agttttgctcttgtcatccacgctggaatgcaatggtgcgatctcggctcgctgcagcctccgcctcccagcttcaagcgattctcctgactcagcctcccaagtagctgggactacaggcatgccccaccattcccag

SEQ ID NO: 1469 - DNA, 177 bp, Artificial Sequence
  Synthetic oligonucleotide
atctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgc

SEQ ID NO: 1470 - DNA, 176 bp, Artificial Sequence
  Synthetic oligonucleotide
ggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgg

SEQ ID NO: 1471 - DNA, 2146 bp, Artificial Sequence
  Synthetic oligonucleotide
gtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctcaaaaaaaaaaaaaaaaaagaaggcaatatctgtgcattctttttaagcatttatttatagagagcataggctttaaaacagacccagtttgaaatcctagaccctctacttacctgctatttaacattaggaaaataacttcttatgtcaagatttttcattaacaaaatgaaggattataatacctacatcacaggcttgttaaaagcatgagatgagagagaatctttgaaaatcatctaacaggctgggcacggtggctcacgcctgtaatcccagcactttgggaggccgaggcgggcagatcacgaggtcaggagatcgagaccatcctaacacagtgaaaccccgtctctactaaaaaaaatacaaaaaattagccgggcgtggctgtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataag

SEQ ID NO: 1472 - DNA, 193 bp, Artificial Sequence
  Synthetic oligonucleotide
gaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatg

SEQ ID NO: 1473 - DNA, 593 bp, Artificial Sequence
  Synthetic oligonucleotide
gtaagatggctgggttattttatttttaaggtagttgtcgcaaacatttgaaaagttcacttattagtgacaaaaaagttaatgcttgagataatgttagtgattcagaaaagttcatcagtgaatcattttacctttgtcattttagacttgtacttacactatttgtcataaatatttgtgtatgtttggtttgcttctcaggactgtgaataactcgaagggatagtatcttgttgtcatatgctcagtcccgctaatgtagagctcaataaatgtttgaatgaatgaatgagggagtgaacaattggagtttctttcttggttcttttcttttcttctctctccatgaccagtccatcagtcaaaaggcagatggggaaaagaaaccattaagggcaactccctaaactttagtattggtgacaaaaatgtgaatctaaataagccaggcatggtggcgcatacctgtaatctaagctactcaggaggccgaggcaggagaatcacttgacaagggaggcagaacttgcagtgagccgagattacaccactgcactccagcctaggtgacagagtgagactccatctca

SEQ ID NO: 1474 - DNA, 273 bp, Artificial Sequence
  Synthetic oligonucleotide
gtaagacaactcatttaggaattttcttcattcttgaaacctcaagtaacatgtctcttatcaggtcttataagtcaaggtatttagtaaagaaacaaaatctttatgatttgaattagaaaagacctgtttatggcacttttgggtcctggtattcaaaaacaaaagaaatgttggtactttagctaaatgattggtacagattacaggcagtcctccatatctgtgggttttgcaaccttggattcaaccaaacacaaatcaaaaatattc

SEQ ID NO: 1475 - DNA, 526 bp, Artificial Sequence
  Synthetic oligonucleotide
gtgaggattcctcaggaacattctgattttcttcaaattcttaggcaggtaccctggtcttcaacttaagattctagctagatggtttccgaaaagcaaaagtctatccttttggaatgcttaggagtgagtgtgtgtgtacatgtattagtctgttctcacactgctataaagaaatacctgagactggataatttaatttaaaaaagaggtttaattggctcacagttctgcgggctgtacaggaagctgagcagcttccacttctgcgaatgcctcaggaaacttaaattcacagtggaaggtgaaggagaagtagccatgtcttacatggcccagcccaagcaagagagaaagggggaaggtgctacacacttttaaaacaaccaggtcttgtgataactcactcactatcacgagaacagcaccaaggggaatggtgttaaaccgtttatgagaaaccgtccccatgatccagttgccttccactaggccccaccttcaacattggggattacaattcaac

SEQ ID NO: 1476 - DNA, 1970 bp, Artificial Sequence
  Synthetic oligonucleotide
acttttattttgaaaaattttaaacccacagaaaagctgaaaaagtggtataatgaatgctgatatgcccttcacctggatgtaatcttgttaacattatatttgctttgcccttctcttcctctttctacacacccacactcaccacacaaacaactttgtttttacctgaatcatttgaaagtttcagatgtcatgacacttcacccctaaattcttttgtacaaatcttataaggataaattttcctacagaaccacaattccattgtcatacctaagaaaactaacatgattgaagaataatttaaatatggtttatattcaaattttctcagttctaccaaaagtgtcttttataagttgtctttcctcctgatatattacattggtttatggtatctttttaaaatctagaacaatcaccccacctctcttttttctttaaaaccacatcaggctatgctataatttttgtttcaatcatcaaacataatgtagaaaacttaagaggaaaaggaaagtctattacatttacctatacttttgcttactgtgttcattcttccttcctgaagtaccaagattctttattttgtcacttctgtttagagaaatttctttagcctttcttttagggtaggtctgctgatgaaaaattatcatagctttccttttgagaatgtgttgatttccctttgatttttaaaggttatttttgctggatgtagaactctggttcaacagttcttatctttagcacttaaaaaatgttaagagcccagtccacttgtgctgtaagatgtcccatccataatcaggatttgtcagattgcttcctcatgattgggttgagttaaacatttttggtagaagtactacataatcttcatgtcaggaaacagttaatatcagtttgtctcacttttggaaaccaagttgatcacttcgctaaggaagtaactgctagatgtttccttataaaaaggtacatttttccttttatcatttttttaagcaatttctggagtaatattttgagaccatgtgaatatcctattttccaattatcttgaacccagttttagcattcattgatcatccttgaaatattagctagagaattacaaaattctggctttactaaatctgtcattccttctacatttattagctagcagtattctctaaagaagagccttcctttttttctttaattcaatgtattataagcaattactgtcagtattgtttttgatggtcaaattgccttaaatttggccaataagagccccttcaagttatatgtatcctttaaaactgtccccattttaatttttgaaaacttgttttattgtataacaagatggtctgggattttgtactttctctgcccaaacctggaattaaaactaccctgagctaatttctcatctaatggattgccaaaaattcaaaaactgaacaacacactctgtctgcaaggctataggtggaagttcaaaatggtacaacttctttgcaggggaattttgcaatatctaattacatatgcatttgtcgtttgatgaagcaatctcctcctcatctaagaagatttcaagaataccaaaaaaatacatacacaaagtaattctctggggcattgtataaaatagctaaatattgaaaacaatctaaatacccaaccacagaagactggtttactcaattatggtaaaaccaagtaatggagtactatacagcaataagaaatgaatgaagaaggtttctgtgaactgatacagaatgatttccaagatatattgttaagtaaacaaaacgtagtacaaaagcattatatagcataatatttttggttgttttttaaaccttatcctgtattgtacttattagcactggaaagtggaagaggtctctgctaattagggtggagaattaatcacctactgggtttccttcttttcccag

SEQ ID NO: 1477 - DNA, 466 bp, Artificial Sequence
  Synthetic oligonucleotide
gattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggag

SEQ ID NO: 1478 - DNA, 1795 bp, Artificial Sequence
  Synthetic oligonucleotide
cagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaagagagagagagagagatgggctctccctgtgttgcccaggctagtctcaaactcctgggctcaagtgatctgcctccctcag

SEQ ID NO: 1479 - DNA, 383 bp, Artificial Sequence
  Synthetic oligonucleotide
cctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaaaatccagaacaga

SEQ ID NO: 1480 - DNA, 110 bp, Artificial Sequence
  Synthetic oligonucleotide
ctaagctaccctctgtacagaatctgccctcagccatccttcacccatgctgggcctcaactccccctggacaggatggtttacctaacttactgccgttgtttgtacag

SEQ ID NO: 1481 - DNA, 106 bp, Artificial Sequence
  Synthetic oligonucleotide
cctgactttgaaaccaaaagttggctaaggagaagaatgtcatgtcctccacctgtcctcaagctgatcagtgcatcacccttcatccactacactaagtgtagag

SEQ ID NO: 1482 - DNA, 24 bp, Artificial Sequence
  Synthetic oligonucleotide
gtttttgaattgtatacactatag

SEQ ID NO: 1483 - DNA, 99 bp, Artificial Sequence
  Synthetic oligonucleotide
gacagtcacttggggatttagatggaattcctattgcagtaaaagacaatttcagcacttctggcattgagacaacatgtgcatcaaatatgctgaaag

SEQ ID NO: 1484 - DNA, 85 bp, Artificial Sequence
  Synthetic oligonucleotide
gttatataccaccttataatgctacagtagttcagaagttgttggatcagggagctctactaatgggaaaaacaaatttagatga

SEQ ID NO: 1485 - DNA, 5 bp, Artificial Sequence
  Synthetic oligonucleotide
gtttg

SEQ ID NO: 1486 - DNA, 7 bp, Artificial Sequence
  Synthetic oligonucleotide
ctatggg

SEQ ID NO: 1487 - DNA, 116 bp, Artificial Sequence
  Synthetic oligonucleotide
tacagtgggttcttaaatgctcaatgagtgtcagaagcaaataatatactcagaagatgaaattttcacataaaatgaaagttttactaaggtatcttgcttcacttcgtcatcag

SEQ ID NO: 1488 - DNA, 116 bp, Artificial Sequence
  Synthetic oligonucleotide
gtgcactggccggacctgaccccagggactctaccacagtacatgaacctattaataaaccattcatgcttcccagtttggcagatgtgagcaaactatgtataggaattccaaag

SEQ ID NO: 1489 - DNA, 118 bp, Artificial Sequence
  Synthetic oligonucleotide
gtcacagatgtgacattgatgtgtccactgaagccatgtatgctgcaaccagacgagaagggtttaatgatgtggtgagaggaagaattctctcaggaaactttttcttattaaaaga

SEQ ID NO: 1490 - DNA, 98 bp, Artificial Sequence
  Synthetic oligonucleotide
aaactatgaaaattattttgtcaaagcacagaaagtgagacgcctcattgctaatgactttgtaaatgcttttaactctggagtagatgtcttgctaa

SEQ ID NO: 1491 - DNA, 108 bp, Artificial Sequence
  Synthetic oligonucleotide
ctcccaccaccttgagtgaggcagtaccatacttggagttcatcaaagaggacaacagaacccgaagtgcccaggatgatatttttacacaagctgtaaatatggcag

SEQ ID NO: 1492 - DNA, 4 bp, Artificial Sequence
  Synthetic oligonucleotide
gttg

SEQ ID NO: 1493 - DNA, 2239 bp, Homo sapiens
tggggagggggaggagcctcgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtgagtaggtgagggcgggagggggtgctgccacgggctcctggggagatagtggctggccatggaggcactgctgggctcagggtgcagtcggtgttctgggaccccgatgtggcccttcctcatgggcaggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 1494 - DNA, 2568 bp, Homo sapiens
taggtggcttttttggggactgagcccctcactctggcgcccaggctacattgcagtggcgcggtcttggctcagtgaagcctcgacctgccggactaaagcagttctcccgcctcagcctccccaagtagccgggactacaggtgcacgccaccacacccggctaattattatggtctttaaatttaaaaaaaaaattttttttagacggagtctcgctctatcccccaggctggagtgcattggcgcagtctcagctgcaacctccgcctcctggttcaaacgagtctcctgcctcagcctcctgagcagatgggattacgggcgcccgccaccatgcccggctaatttttgtgtttttagtagagacggggtttcgccatgttggccaggctggtctcgaactcatgacctcatgatgcacccgcctcggcgtgccaaagtgctgggattacaggcgtgagccaccgcgcccggcctaattattatattttgtgtagagatggagtctcaccatgttgcccaggctggtctcgaactcctgggctcaagcgatccgccggcctcagtcttccaaagtgctgggattccaggcatgacccaccgcgcccgccccccgacgccaccgatgtggagtgtgagattgtcctctcgttgctgtttacccattgcaactcagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 1495 - DNA, 2312 bp, Homo sapiens
tggggagggggaggagcctcgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtgagtaggtgagggcgggagggggtgctgccacgggctcctggggagatagtggctggccatggaggcactgctgggctcagggtgcagtcggtgttctgggaccccgatgtggcccttcctcatgggcaggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 1496 - DNA, 770 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 1497 - DNA, 843 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 1498 - DNA, 877 bp, Homo sapiens
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggc

SEQ ID NO: 1499 - DNA, 1454 bp, Homo sapiens
taggtggcttttttggggactgagcccctcactctggcgcccaggctacattgcagtggcgcggtcttggctcagtgaagcctcgacctgccggactaaagcagttctcccgcctcagcctccccaagtagccgggactacaggtgcacgccaccacacccggctaattattatggtctttaaatttaaaaaaaaaattttttttagacggagtctcgctctatcccccaggctggagtgcattggcgcagtctcagctgcaacctccgcctcctggttcaaacgagtctcctgcctcagcctcctgagcagatgggattacgggcgcccgccaccatgcccggctaatttttgtgtttttagtagagacggggtttcgccatgttggccaggctggtctcgaactcatgacctcatgatgcacccgcctcggcgtgccaaagtgctgggattacaggcgtgagccaccgcgcccggcctaattattatattttgtgtagagatggagtctcaccatgttgcccaggctggtctcgaactcctgggctcaagcgatccgccggcctcagtcttccaaagtgctgggattccaggcatgacccaccgcgcccgccccccgacgccaccgatgtggagtgtgagattgtcctctcgttgctgtttacccattgcaactcagtagagaaggggtttcaccatattggccagcctggtctcgaactcctgagctcaagtgatccacctgcctcagcctcccaaactgctggggttaccagcatgagccactgcacccggccctcactgcggcctttaactccagggatcaagtgatcctcctactccagcctcctgaggagctgggactacaggagaggagactaatccgaagctcagaaaggctcagtgcattcccaaggtcgttcagccaggagagcgctgaagggatctgagctgagagcaagtctcaaactcagagaatggaggagctgccccggaagtggctgctcgaggctgcagtgaactatgatcctgcggccaatcgcggtggctcacgcctgtaatcccagccttctgggaggccgaggcgggcggatcgcttgaggtcagaagttcgacactagcttggccaacatggtaaaacaccgtctctacaaaaaaatgcaaaaattagttgggtgtggtggcgcgcgcctgtggtcccagctactcaggaggctgaggtgggaggaacgcttgagcgggggaggcggaagttacagtgagtcgagatcgccccactgcactccagcctggacaacagaatgagaccctgtctaaaaataaaatacatgagccgagtgcggtggcgcgcgcctgtgatctcacatactcggcaggctgaggttgggagaaccgcctgaacctggggactgcaccactgcattccagccttggtgacagtgagaccctgtcta

SEQ ID NO: 1500 - DNA, 1264 bp, Homo sapiens
taggtggcttttttggggactgagcccctcactctggcgcccaggctacattgcagtggcgcggtcttggctcagtgaagcctcgacctgccggactaaagcagttctcccgcctcagcctccccaagtagccgggactacaggtgcacgccaccacacccggctaattattatggtctttaaatttaaaaaaaaaattttttttagacggagtctcgctctatcccccaggctggagtgcattggcgcagtctcagctgcaacctccgcctcctggttcaaacgagtctcctgcctcagcctcctgagcagatgggattacgggcgcccgccaccatgcccggctaatttttgtgtttttagtagagacggggtttcgccatgttggccaggctggtctcgaactcatgacctcatgatgcacccgcctcggcgtgccaaagtgctgggattacaggcgtgagccaccgcgcccggcctaattattatattttgtgtagagatggagtctcaccatgttgcccaggctggtctcgaactcctgggctcaagcgatccgccggcctcagtcttccaaagtgctgggattccaggcatgacccaccgcgcccgccccccgacgccaccgatgtggagtgtgagattgtcctctcgttgctgtttacccattgcaactcaggagaggagactaatccgaagctcagaaaggctcagtgcattcccaaggtcgttcagccaggagagcgctgaagggatctgagctgagagcaagtctcaaactcagagaatggaggagctgccccggaagtggctgctcgaggctgcagtgaactatgatcctgcggccaatcgcggtggctcacgcctgtaatcccagccttctgggaggccgaggcgggcggatcgcttgaggtcagaagttcgacactagcttggccaacatggtaaaacaccgtctctacaaaaaaatgcaaaaattagttgggtgtggtggcgcgcgcctgtggtcccagctactcaggaggctgaggtgggaggaacgcttgagcgggggaggcggaagttacagtgagtcgagatcgccccactgcactccagcctggacaacagaatgagaccctgtctaaaaataaaatacatgagccgagtgcggtggcgcgcgcctgtgatctcacatactcggcaggctgaggttgggagaaccgcctgaacctggggactgcaccactgcattccagccttggtgacagtgagaccctgtcta

SEQ ID NO: 1501 - DNA, 679 bp, Artificial Sequence
  Synthetic oligonucleotide
taggtggcttttttggggactgagcccctcactctggcgcccaggctacattgcagtggcgcggtcttggctcagtgaagcctcgacctgccggactaaagcagttctcccgcctcagcctccccaagtagccgggactacaggtgcacgccaccacacccggctaattattatggtctttaaatttaaaaaaaaaattttttttagacggagtctcgctctatcccccaggctggagtgcattggcgcagtctcagctgcaacctccgcctcctggttcaaacgagtctcctgcctcagcctcctgagcagatgggattacgggcgcccgccaccatgcccggctaatttttgtgtttttagtagagacggggtttcgccatgttggccaggctggtctcgaactcatgacctcatgatgcacccgcctcggcgtgccaaagtgctgggattacaggcgtgagccaccgcgcccggcctaattattatattttgtgtagagatggagtctcaccatgttgcccaggctggtctcgaactcctgggctcaagcgatccgccggcctcagtcttccaaagtgctgggattccaggcatgacccaccgcgcccgccccccgacgccaccgatgtggagtgtgagattgtcctctcgttgctgtttacccattgcaactcag

SEQ ID NO: 1502 - DNA, 190 bp, Artificial Sequence
  Synthetic oligonucleotide
tagagaaggggtttcaccatattggccagcctggtctcgaactcctgagctcaagtgatccacctgcctcagcctcccaaactgctggggttaccagcatgagccactgcacccggccctcactgcggcctttaactccagggatcaagtgatcctcctactccagcctcctgaggagctgggactacag

SEQ ID NO: 1503 - DNA, 585 bp, Artificial Sequence
  Synthetic oligonucleotide
gagaggagactaatccgaagctcagaaaggctcagtgcattcccaaggtcgttcagccaggagagcgctgaagggatctgagctgagagcaagtctcaaactcagagaatggaggagctgccccggaagtggctgctcgaggctgcagtgaactatgatcctgcggccaatcgcggtggctcacgcctgtaatcccagccttctgggaggccgaggcgggcggatcgcttgaggtcagaagttcgacactagcttggccaacatggtaaaacaccgtctctacaaaaaaatgcaaaaattagttgggtgtggtggcgcgcgcctgtggtcccagctactcaggaggctgaggtgggaggaacgcttgagcgggggaggcggaagttacagtgagtcgagatcgccccactgcactccagcctggacaacagaatgagaccctgtctaaaaataaaatacatgagccgagtgcggtggcgcgcgcctgtgatctcacatactcggcaggctgaggttgggagaaccgcctgaacctggggactgcaccactgcattccagccttggtgacagtgagaccctgtcta

SEQ ID NO: 1504 - DNA, 144 bp, Artificial Sequence
  Synthetic oligonucleotide
tggggagggggaggagcctcgaggccggtttggaatttttggcgcgagcagctccgcgcgcgttcacgggccgttccccctcacgggagtcctccgcccgggcgtccggaacagtcgacggcagactccggcccgctgagccac

SEQ ID NO: 1505 - DNA, 207 bp, Artificial Sequence
  Synthetic oligonucleotide
ggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccag

SEQ ID NO: 1506 - DNA, 161 bp, Artificial Sequence
  Synthetic oligonucleotide
gctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaag

SEQ ID NO: 1507 - DNA, 150 bp, Artificial Sequence
  Synthetic oligonucleotide
ttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagc

SEQ ID NO: 1508 - DNA, 132 bp, Artificial Sequence
  Synthetic oligonucleotide
gtgagtaggtgagggcgggagggggtgctgccacgggctcctggggagatagtggctggccatggaggcactgctgggctcagggtgcagtcggtgttctgggaccccgatgtggcccttcctcatgggcag

SEQ ID NO: 1509 - DNA, 173 bp, Artificial Sequence
  Synthetic oligonucleotide
gtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcag

SEQ ID NO: 1510 - DNA, 158 bp, Artificial Sequence
  Synthetic oligonucleotide
gccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagg

SEQ ID NO: 1511 - DNA, 408 bp, Artificial Sequence
  Synthetic oligonucleotide
ccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctag

SEQ ID NO: 1512 - DNA, 161 bp, Artificial Sequence
  Synthetic oligonucleotide
actctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggc

SEQ ID NO: 1513 - DNA, 74 bp, Artificial Sequence
  Synthetic oligonucleotide
ccgaggggtcccgtggcctccgcggacccggaatctgggccctcgcggacccgcgccccgcccagtcgccccag

SEQ ID NO: 1514 - DNA, 64 bp, Artificial Sequence
  Synthetic oligonucleotide
ggcttccccacacccacggagtgaagtcagccgcggccctgcctgggaggaacttaccgtctac

SEQ ID NO: 1515 - DNA, 33 bp, Artificial Sequence
  Synthetic oligonucleotide
cgggaaaggtggccagcagatgtgtcgggcctg

SEQ ID NO: 1516 - DNA, 8 bp, Artificial Sequence
  Synthetic oligonucleotide
gtgagagg

SEQ ID NO: 1517 - DNA, 51 bp, Artificial Sequence
  Synthetic oligonucleotide
gtgaggcgagacggcccgatcgcccagggccccggaagctgcggaggtcac

SEQ ID NO: 1518 - DNA, 102 bp, Artificial Sequence
  Synthetic oligonucleotide
ccccgcctggccttagctcagggacaccctggattcacgtgggagcccctgctcctgcctcccccgtcccaccactgaggctgttgggccaggccagtcatg

SEQ ID NO: 1519 - DNA, 7 bp, Artificial Sequence
  Synthetic oligonucleotide
ctagaac

SEQ ID NO: 1520 - DNA, 47 bp, Artificial Sequence
  Synthetic oligonucleotide
gtgcgctccaaggaggacggccggctctatgcggtaaagcgttccat

SEQ ID NO: 1521 - DNA, 37 bp, Artificial Sequence
  Synthetic oligonucleotide
gtcaccattccggggccccaaggaccgggcccgcaag

SEQ ID NO: 1522 - DNA, 39 bp, Artificial Sequence
  Synthetic oligonucleotide
ctgcctgaggcccaggtctggggctacctgcgggacacg

SEQ ID NO: 1523 - DNA, 4 bp, Artificial Sequence
  Synthetic oligonucleotide
ctgc

SEQ ID NO: 1524 - DNA, 70 bp, Artificial Sequence
  Synthetic oligonucleotide
ttgccctggcccatctgcacagccagggcctggtgcaccttgatgtcaagcctgccaacatcttcctggg

SEQ ID NO: 1525 - DNA, 37 bp, Artificial Sequence
  Synthetic oligonucleotide
gccccggggccgctgcaagctgggtgacttcggactg

SEQ ID NO: 1526 - DNA, 19 bp, Artificial Sequence
  Synthetic oligonucleotide
ctggtggagctgggtacag

SEQ ID NO: 1527 - DNA, 91 bp, Artificial Sequence
  Synthetic oligonucleotide
caggagctggtgaggtccaggagggagacccccgctacatggcccccgagctgctgcagggctcctatgggacagcagcggatgtgttcag

SEQ ID NO: 1528 - DNA, 107 bp, Artificial Sequence
  Synthetic oligonucleotide
tctgggcctcaccatcctggaagtggcatgcaacatggagctgccccacggtggggagggctggcagcagctgcgccagggctacctgccccctgagttcactgccg

SEQ ID NO: 1529 - DNA, 38 bp, Artificial Sequence
  Synthetic oligonucleotide
ccctggacaccctccttgtctcgcctgccctcctgcag

SEQ ID NO: 1530 - DNA, 78 bp, Artificial Sequence
  Synthetic oligonucleotide
gccttcactctcccctgaggctgtcctggcccggactgtggggagcacctccaccccccggagcaggtgcacacccag

SEQ ID NO: 1531 - DNA, 73 bp, Artificial Sequence
  Synthetic oligonucleotide
gtaagcaggtccaggggctggggtgggcagggctagcttttggatcctgagtgtcactactctctcctcccag

SEQ ID NO: 1532 - DNA, 96 bp, Artificial Sequence
  Synthetic oligonucleotide
ggatgccctggacctaagtgacatcaactcagagcctcctcggggctccttcccctcctttgagcctcggaacctcctcagcctgtttgaggacac

SEQ ID NO: 1533 - DNA, 23 bp, Artificial Sequence
  Synthetic oligonucleotide
cctagacccaacctgagccccag

SEQ ID NO: 1534 - DNA, 2151 bp, Homo sapiens
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgagtgagtactgccccgcagagggcctgggtgaaggggccacccagcaaggatggcaatgtgtatgggaggagagccgcgttgcttctagaggctgaatgcctgtcaaatggagaaggcttccatttacttcagaaagctacactgactctactaaaaggcccctttcctgctggcttttaggaaaagagagaattccctcatcagtctcaaaatcacaagcaacagaaatgggaaatcgttttactaaga

SEQ ID NO: 1535 - DNA, 1298 bp, Artificial Sequence
  Synthetic oligonucleotide
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtg

SEQ ID NO: 1536 - DNA, 170 bp, Artificial Sequence
  Synthetic oligonucleotide
ggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacag

SEQ ID NO: 1537 - DNA, 143 bp, Artificial Sequence
  Synthetic oligonucleotide
cggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccag

SEQ ID NO: 1538 - DNA, 148 bp, Artificial Sequence
  Synthetic oligonucleotide
ggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcgg

SEQ ID NO: 1539 - DNA, 249 bp, Artificial Sequence
  Synthetic oligonucleotide
gtgagtactgccccgcagagggcctgggtgaaggggccacccagcaaggatggcaatgtgtatgggaggagagccgcgttgcttctagaggctgaatgcctgtcaaatggagaaggcttccatttacttcagaaagctacactgactctactaaaaggcccctttcctgctggcttttaggaaaagagagaattccctcatcagtctcaaaatcacaagcaacagaaatgggaaatcgttttactaaga

SEQ ID NO: 1540 - DNA, 38 bp, Artificial Sequence
  Synthetic oligonucleotide
ggaggaggaggggaagcggcgaaggaggaagaggagga

SEQ ID NO: 1541 - DNA, 41 bp, Artificial Sequence
  Synthetic oligonucleotide
gagctcccagcagaaaggccgcctgtccctgcagaatacag

SEQ ID NO: 1542 - DNA, 11 bp, Artificial Sequence
  Synthetic oligonucleotide
ctgcccaggag

SEQ ID NO: 1543 - DNA, 53 bp, Artificial Sequence
  Synthetic oligonucleotide
aacacccgggtgatagtggagatgatccatttcaaggacttgctgctgcacga

SEQ ID NO: 1544 - DNA, 1333 bp, Homo sapiens
agtcctccccgcttcccggttcgctcaggcagtgcacatcccagagctccttccccgcttggacccgaactgttctcactgaatgatctcctcgctgacatccaggccgaaagtcttccgcaactgctgggtgcaccagtgcaccagcggctccccggacaccgccccagccaccgccatcttccccagccggaaccagctgagctgcaaaagccccacgtcctgcaccggactagttcccttcgcaacaccaacctctctcacgcgggttccgccagcttgcaccgccccgcaaggtcgcaccgcctccagtgcagatcccgcccatctgtgcgcctcctgcttcttcctgctttgttgtctacttccttgtgccctccggagtcgagctctgtcagtgcatgattcttgccaatcgctaaacgtaggactcgaggaaggccattggcaattctgctaagaagacagtgcaagtgcctataaaaacgacagtttagggggaaaacaaaccaatacccggaaagctgagaggccagctttttaatcgtcatggttttatgtaaaataaaacagcacgtggaaggtattgtaagcgcttggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacatt

SEQ ID NO: 1545 - DNA, 854 bp, Homo sapiens
taaggttatcctgctgttctggatcgccaggctctcctctccaagctgctggggtccaggactcggtgtcggaaccctcctgccccttctgaacacccttttttgcctctcttcacagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacatt

SEQ ID NO: 1546 - DNA, 1328 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctc

SEQ ID NO: 1547 - DNA, 493 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagatggggtttcatcacattgcccaggctggtctcgaactcctgggctgaagcaatcctcccgcctcagcctaccaaagtgctgggattacagacgtgagccaccacgcctggcctgatgaaatttcattagagccgcatctcatcgtctggtccactgttgaatcaccagagccaactaaataggcccttactgaatatatgttgaataaatgcatcctttaaggc

SEQ ID NO: 1548 - DNA, 1172 bp, Homo sapiens
agtcctccccgcttcccggttcgctcaggcagtgcacatcccagagctccttccccgcttggacccgaactgttctcactgaatgatctcctcgctgacatccaggccgaaagtcttccgcaactgctgggtgcaccagtgcaccagcggctccccggacaccgccccagccaccgccatcttccccagccggaaccagctgagctgcaaaagccccacgtcctgcaccggactagttcccttcgcaacaccaacctctctcacgcgggttccgccagcttgcaccgccccgcaaggtcgcaccgcctccagtgcagatcccgcccatctgtgcgcctcctgcttcttcctgctttgttgtctacttccttgtgccctccggagtcgagctctgtcagtgcatgattcttgccaatcgctaaacgtaggactcgaggaaggccattggcaattctgctaagaagacagtgcaagtgcctataaaaacgacagtttagggggaaaacaaaccaatacccggaaagctgagaggccagctttttaatcgtcatggttttatgtaaaataaaacagcacgtggaaggtattgtaagcgctagacggagactcgccctgtcgcccaggctggagtgcagtagcgtgatctcggctcactgcaacctccgcctcccgggttcaaggaattctcctgcctcagcctccagagtagctgggactacaggcacatgccgccactcccagctaattttttattttttatttttatttttattttagtagagactgggtttcaccatgttgcccacgctggtctcgaactcctgagctcaggcaatctgcctgcctcggcctcccaaagtgctaggattacaggtgtgagccaccatgcctgaccgattctgttttatgtatggtatttagagagtgaaaatcactccccaggggtgttgtgagtaattagaaggtaagcataaagatagaaaaaaattatgaccctttatcctagagttatgctcactgtgtgacagcgatgtggtcttaccacatttggcagggtcttttcgtttcgtttcgtttcatttcatttccttgccttgccttgcctttcttttcttttttcttttcttttctttctttcttttcttttctttctttctttctttttttttttt

SEQ ID NO: 1549 - DNA, 597 bp, Artificial Sequence
  Synthetic oligonucleotide
agtcctccccgcttcccggttcgctcaggcagtgcacatcccagagctccttccccgcttggacccgaactgttctcactgaatgatctcctcgctgacatccaggccgaaagtcttccgcaactgctgggtgcaccagtgcaccagcggctccccggacaccgccccagccaccgccatcttccccagccggaaccagctgagctgcaaaagccccacgtcctgcaccggactagttcccttcgcaacaccaacctctctcacgcgggttccgccagcttgcaccgccccgcaaggtcgcaccgcctccagtgcagatcccgcccatctgtgcgcctcctgcttcttcctgctttgttgtctacttccttgtgccctccggagtcgagctctgtcagtgcatgattcttgccaatcgctaaacgtaggactcgaggaaggccattggcaattctgctaagaagacagtgcaagtgcctataaaaacgacagtttagggggaaaacaaaccaatacccggaaagctgagaggccagctttttaatcgtcatggttttatgtaaaataaaacagcacgtggaaggtattgtaagcgct

SEQ ID NO: 1550 - DNA, 575 bp, Artificial Sequence
  Synthetic oligonucleotide
agacggagactcgccctgtcgcccaggctggagtgcagtagcgtgatctcggctcactgcaacctccgcctcccgggttcaaggaattctcctgcctcagcctccagagtagctgggactacaggcacatgccgccactcccagctaattttttattttttatttttatttttattttagtagagactgggtttcaccatgttgcccacgctggtctcgaactcctgagctcaggcaatctgcctgcctcggcctcccaaagtgctaggattacaggtgtgagccaccatgcctgaccgattctgttttatgtatggtatttagagagtgaaaatcactccccaggggtgttgtgagtaattagaaggtaagcataaagatagaaaaaaattatgaccctttatcctagagttatgctcactgtgtgacagcgatgtggtcttaccacatttggcagggtcttttcgtttcgtttcgtttcatttcatttccttgccttgccttgcctttcttttcttttttcttttcttttctttctttcttttcttttctttctttctttctttttttttttt

SEQ ID NO: 1551 - DNA, 185 bp, Artificial Sequence
  Synthetic oligonucleotide
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaag

SEQ ID NO: 1552 - DNA, 227 bp, Artificial Sequence
  Synthetic oligonucleotide
agatggggtttcatcacattgcccaggctggtctcgaactcctgggctgaagcaatcctcccgcctcagcctaccaaagtgctgggattacagacgtgagccaccacgcctggcctgatgaaatttcattagagccgcatctcatcgtctggtccactgttgaatcaccagagccaactaaataggcccttactgaatatatgttgaataaatgcatcctttaaggc

SEQ ID NO: 1553 - DNA, 163 bp, Artificial Sequence
  Synthetic oligonucleotide
ctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaa

SEQ ID NO: 1554 - DNA, 709 bp, Artificial Sequence
  Synthetic oligonucleotide
ttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctc

SEQ ID NO: 1555 - DNA, 118 bp, Artificial Sequence
  Synthetic oligonucleotide
taaggttatcctgctgttctggatcgccaggctctcctctccaagctgctggggtccaggactcggtgtcggaaccctcctgccccttctgaacacccttttttgcctctcttcacag

SEQ ID NO: 1556 - DNA, 81 bp, Artificial Sequence
  Synthetic oligonucleotide
tggtggctgctcgagcccccagaaaggtgcttggttcttccacctctgccactaattcgacatcagtttcatcgaggaaag

SEQ ID NO: 1557 - DNA, 61 bp, Artificial Sequence
  Synthetic oligonucleotide
agcatgtcctttgcaacctgatcacacaaatgatgaaaaagaatagaactttctcattcat

SEQ ID NO: 1558 - DNA, 25 bp, Artificial Sequence
  Synthetic oligonucleotide
ctttgaataacgtctccttgtttac

SEQ ID NO: 1559 - DNA, 97 bp, Artificial Sequence
  Synthetic oligonucleotide
cctggtattctagaatgtaaatttacataaatgtgtttgttccaattagctttgttgaacaggcatttaattaaaaaatttaggtttaaatttagat

SEQ ID NO: 1560 - DNA, 55 bp, Artificial Sequence
  Synthetic oligonucleotide
gttcaaaagtagttgtgaaatttgagaatttgtaagactaattatggtaacttag

SEQ ID NO: 1561 - DNA, 61 bp, Artificial Sequence
  Synthetic oligonucleotide
cttagtattcaatataatgcattgtttggtttcttttaccaaattaagtgtctagttcttg

SEQ ID NO: 1562 - DNA, 54 bp, Artificial Sequence
  Synthetic oligonucleotide
ctaaaatcaagtcattgcattgtgttctaattacaagtatgttgtatttgagat

SEQ ID NO: 1563 - DNA, 3915 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1564 - DNA, 4077 bp, Homo sapiens
ggatcgacggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaagggccaggctggagtgtagtggtgtgatcacggctcagtgcggcctcagccacccgggctcaagtgatcctcccgccccagccttccaagtagctgggaacatacccgcccaccactacacctgtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1565 - DNA, 4139 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1566 - DNA, 4087 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaagtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcagggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1567 - DNA, 4099 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaagggccaggctggagtgtagtggtgtgatcacggctcagtgcggcctcagccacccgggctcaagtgatcctcccgccccagccttccaagtagctgggaacatacccgcccaccactacacctgtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctctaatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1568 - DNA, 4028 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagagatggggtttcaccgtgttagccaggatggtctcgatctcctgaccttgtgatccgcccgccttggcctcccagagtgctggaattactgacatgagccaccgcggccggagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1569 - DNA, 4066 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaagtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1570 - DNA, 1496 bp, Homo sapiens
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaagggtagaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacaca

SEQ ID NO: 1571 - DNA, 1818 bp, Homo sapiens
ggatcgacggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacggtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtagcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaagggtagaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacaca

SEQ ID NO: 1572 - DNA, 988 bp, Homo sapiens
accaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1573 - DNA, 175 bp, Artificial Sequence
  Synthetic oligonucleotide
agggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaat

SEQ ID NO: 1574 - DNA, 199 bp, Artificial Sequence
  Synthetic oligonucleotide
gtctctgtccctctctctctgggtctctgtccctctctctctgggtctctgtccccatctctctgggtctctgtccctctctctctgggtctctgtccccgtctctctgggtctttgtccccgtctctctgggtctctgtccccgtctctctgggtctctgtccccctccctgtgtaccccgctcccatgtgtccacag

SEQ ID NO: 1575 - DNA, 181 bp, Artificial Sequence
  Synthetic oligonucleotide
ttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacag

SEQ ID NO: 1576 - DNA, 159 bp, Artificial Sequence
  Synthetic oligonucleotide
gtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtag

SEQ ID NO: 1577 - DNA, 414 bp, Artificial Sequence
  Synthetic oligonucleotide
gtagaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacaca

SEQ ID NO: 1578 - DNA, 122 bp, Artificial Sequence
  Synthetic oligonucleotide
gccaggctggagtgtagtggtgtgatcacggctcagtgcggcctcagccacccgggctcaagtgatcctcccgccccagccttccaagtagctgggaacatacccgcccaccactacacctg

SEQ ID NO: 1579 - DNA, 290 bp, Artificial Sequence
  Synthetic oligonucleotide
tccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgag

SEQ ID NO: 1580 - DNA, 135 bp, Artificial Sequence
  Synthetic oligonucleotide
atgtatctgctctcggacaaggccacctcgccgctctcgctggatgctggcctcgggcaggccccctggagcgacctgcttctttgggcactgttgctgaacagggcacagatggccatgtacttctgggagatg

SEQ ID NO: 1581 - DNA, 130 bp, Artificial Sequence
  Synthetic oligonucleotide
ggttccaatgcagtttcctcagctcttggggcctgtttgctgctccgggtgatggcacgcctggagcctgacgctgaggaggcagcacggaggaaagacctggcgttcaagtttgaggggatgggcgttg

SEQ ID NO: 1582 - DNA, 175 bp, Artificial Sequence
  Synthetic oligonucleotide
gtgcgtggggcacggtgcctgggagcagggacgggggctgccgccagagggggatgtgcaactccgcactcctctaatatccctgcgccatccccttaaattcccttacctctcccttcacaccctcaccctactccttcccatccctgtcacataactaactcctctgccccag

SEQ ID NO: 1583 - DNA, 146 bp, Artificial Sequence
  Synthetic oligonucleotide
acctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacag

SEQ ID NO: 1584 - DNA, 435 bp, Artificial Sequence
  Synthetic oligonucleotide
gacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccg

SEQ ID NO: 1585 - DNA, 133 bp, Artificial Sequence
  Synthetic oligonucleotide
gctgaccccgggtttgtaccacctgggccgcactgtcctctgcatcgacttcatggttttcacggtgcggctgcttcacatcttcacggtcaacaaacagctggggcccaagatcgtcatcgtgagcaagatg

SEQ ID NO: 1586 - DNA, 175 bp, Artificial Sequence
  Synthetic oligonucleotide
atgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacg

SEQ ID NO: 1587 - DNA, 197 bp, Artificial Sequence
  Synthetic oligonucleotide
ttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttcc

SEQ ID NO: 1588 - DNA, 133 bp, Artificial Sequence
  Synthetic oligonucleotide
gggtttacctttctaaggaagccgagcggaagctgctaacgtgggaatcggtgcataaggagaactttctgctggcacgcgctagggacaagcgggagagcgactccgagcgtctgaagcgcacgtcccagaa

SEQ ID NO: 1589 - DNA, 172 bp, Artificial Sequence
  Synthetic oligonucleotide
gtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcag

SEQ ID NO: 1590 - DNA, 224 bp, Artificial Sequence
  Synthetic oligonucleotide
gtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccag

SEQ ID NO: 1591 - DNA, 343 bp, Artificial Sequence
  Synthetic oligonucleotide
actgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 1592 - DNA, 119 bp, Artificial Sequence
  Synthetic oligonucleotide
ggatcgacggtttgctctgggcgggtctggaagcagagccggcggagggagcgccggggccctgggctgcaggaggttgcggcggccgcggcagcatggtggtgccggagaaggagcag

SEQ ID NO: 1593 - DNA, 68 bp, Artificial Sequence
  Synthetic oligonucleotide
agctggatccccaagatcttcaagaagaagacctgcacgacgttcatagttgactccacagatccggg

SEQ ID NO: 1594 - DNA, 51 bp, Artificial Sequence
  Synthetic oligonucleotide
gagcctggattgtcactgggggtctgcacacgggcatcggccggcatgttg

SEQ ID NO: 1595 - DNA, 75 bp, Artificial Sequence
  Synthetic oligonucleotide
gtgtggctgtacgggaccatcagatggccagcactgggggcaccaaggtggtggccatgggtgtggccccctggg

SEQ ID NO: 1596 - DNA, 23 bp, Artificial Sequence
  Synthetic oligonucleotide
gtgtggtccggaatagagacacc

SEQ ID NO: 1597 - DNA, 15 bp, Artificial Sequence
  Synthetic oligonucleotide
ctcatcaaccccaag

SEQ ID NO: 1598 - DNA, 5 bp, Artificial Sequence
  Synthetic oligonucleotide
ccaag

SEQ ID NO: 1599 - DNA, 114 bp, Artificial Sequence
  Synthetic oligonucleotide
ggctcgttccctgcgaggtaccggtggcgcggtgacccggaggacggggtccagtttcccctggactacaactactcggccttcttcctggtggacgacggcacacacggctgc

SEQ ID NO: 1600 - DNA, 70 bp, Artificial Sequence
  Synthetic oligonucleotide
ctggggggcgagaaccgcttccgcttgcgcctggagtcctacatctcacagcagaagacgggcgtgggag

SEQ ID NO: 1601 - DNA, 62 bp, Artificial Sequence
  Synthetic oligonucleotide
ggactggaattgacatccctgtcctgctcctcctgattgatggtgatgagaagatgttgacg

SEQ ID NO: 1602 - DNA, 94 bp, Artificial Sequence
  Synthetic oligonucleotide
cgaatagagaacgccacccaggctcagctcccatgtctcctcgtggctggctcagggggagctgcggactgcctggcggagaccctggaagaca

SEQ ID NO: 1603 - DNA, 72 bp, Artificial Sequence
  Synthetic oligonucleotide
ctctggccccagggagtgggggagccaggcaaggcgaagcccgagatcgaatcaggcgtttctttcccaaag

SEQ ID NO: 1604 - DNA, 26 bp, Artificial Sequence
  Synthetic oligonucleotide
gggaccttgaggtcctgcaggcccag

SEQ ID NO: 1605 - DNA, 100 bp, Artificial Sequence
  Synthetic oligonucleotide
gtggagaggattatgacccggaaggagctcctgacagtctattcttctgaggatgggtctgaggaattcgagaccatagttttgaaggcccttgtgaagg

SEQ ID NO: 1606 - DNA, 113 bp, Artificial Sequence
  Synthetic oligonucleotide
cctgtgggagctcggaggcctcagcctacctggatgagctgcgtttggctgtggcttggaaccgcgtggacattgcccagagtgaactctttcggggggacatccaatggcgg

SEQ ID NO: 1607 - DNA, 55 bp, Artificial Sequence
  Synthetic oligonucleotide
gtacccctccgggggcgcctgggaccctcacccaggccagggcttcggggagagc

SEQ ID NO: 1608 - DNA, 113 bp, Artificial Sequence
  Synthetic oligonucleotide
tctctgctgacacagaagtggtggggagatatggccagcactacacccatctgggccctggttctcgccttcttttgccctccactcatctacacccgcctcatcaccttcag

SEQ ID NO: 1609 - DNA, 78 bp, Artificial Sequence
  Synthetic oligonucleotide
gaaatcagaagaggagcccacacgggaggagctagagtttgacatggatagtgtcattaatggggaagggcctgtcgg

SEQ ID NO: 1610 - DNA, 114 bp, Artificial Sequence
  Synthetic oligonucleotide
tggccctcatggagcacagcaactgctcgtcggagcccggcttctgggcacaccctcctggggcccaggcgggcacctgcgtctcccagtatgccaactggctggtggtgctgc

SEQ ID NO: 1611 - DNA, 64 bp, Artificial Sequence
  Synthetic oligonucleotide
tcctcgtcatcttcctgctcgtggccaacatcctgctggtcaacttgctcattgccatgttcag

SEQ ID NO: 1612 - DNA, 113 bp, Artificial Sequence
  Synthetic oligonucleotide
agatggggtttcaccgtgttagccaggatggtctcgatctcctgaccttgtgatccgcccgccttggcctcccagagtgctggaattactgacatgagccaccgcggccggag

SEQ ID NO: 1613 - DNA, 109 bp, Artificial Sequence
  Synthetic oligonucleotide
accaggggctgggtctgggatagcgtgcgtgttctgagggtgtcggaaggggcagctgggattgggaaggggcgtggcctgagccctttgactccgcccgcccctgcag

SEQ ID NO: 1614 - DNA, 73 bp, Artificial Sequence
  Synthetic oligonucleotide
ggtggacttggcactgaaacagctgggacacatccgcgagtacgaacagcgcctgaaagtgctggagcgggag

SEQ ID NO: 1615 - DNA, 70 bp, Artificial Sequence
  Synthetic oligonucleotide
gtccagcagtgtagccgcgtcctggggtgggtggccgaggccctgagccgctctgccttgctgcccccag

SEQ ID NO: 1616 - DNA, 12 bp, Artificial Sequence
  Synthetic oligonucleotide
gtgggccgccac

SEQ ID NO: 1617 - DNA, 24 bp, Artificial Sequence
  Synthetic oligonucleotide
cccctgacctgcctgggtccaaag

SEQ ID NO: 1618 - DNA, 363 bp, Homo sapiens
cccctttcctgggcggggccaaggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggtaaaactctgtctaccctgaactagggatcccagcttctccatcttcctcgcctgattatgaaggatccaagactttcatctttgaatcccctaccctaaagcctggcctgatcattgtgtggttagtgtctgactca

SEQ ID NO: 1619 - DNA, 139 bp, Artificial Sequence
  Synthetic oligonucleotide
gtaaaactctgtctaccctgaactagggatcccagcttctccatcttcctcgcctgattatgaaggatccaagactttcatctttgaatcccctaccctaaagcctggcctgatcattgtgtggttagtgtctgactca

SEQ ID NO: 1620 - DNA, 97 bp, Artificial Sequence
  Synthetic oligonucleotide
cccctttcctgggcggggccaaggctggggcaggggagtcagcagaggcctcgctcgggcgcccagtggtcctgccgcctggtctcacctcgccatg

SEQ ID NO: 1621 - DNA, 48 bp, Artificial Sequence
  Synthetic oligonucleotide
gttcgtctgcctctgcagtgcgtcctctggggctgcttgctgaccgct

SEQ ID NO: 1622 - DNA, 52 bp, Artificial Sequence
  Synthetic oligonucleotide
gtccatccagaaccacccactgcatgcagagaaaaacagtacctaataaaca

SEQ ID NO: 1623 - DNA, 27 bp, Artificial Sequence
  Synthetic oligonucleotide
gtcagtgctgttctttgtgccagccag

SEQ ID NO: 1624 - DNA, 1684 bp, Homo sapiens
cttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaactgccaaacggttttccgaagtggctgcagcacgtgcattcccaccagcattccggaggatcctcaacctagccaccacatggagtgctcagtttggtttttaagccattctaataggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1625 - DNA, 1666 bp, Homo sapiens
cttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1626 - DNA, 1715 bp, Homo sapiens
cttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagagtcatccagaagcaagttttaaccggttttaatgatcattttcgccgtaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1627 - DNA, 1564 bp, Homo sapiens
cttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1628 - DNA, 1566 bp, Homo sapiens
ggtcctcccgcatcagccttttgagatgggaggattgcttgagcccaggagttcgaggctgcagtgagctatgattccaccattgcactgcagcctgggtgacagcaagaacctgtctctttaagaaaaaaaaaagaataaaaaaggaagaaagaaaagttggcagctggtgtcatgattgttctcctgaatttgtgtcatgaaggactggagagaaccaattcccacaagtgtgatggcagcccttgtagatcgtggttttcgtgagtttcacttgagggttgttctgatgctgtaggtactaaatgctgtttgcacagtctttgagagagcggcctgcaggtgttagcattagagggatggcctgcgtacttccaatgagaccctcatttaggacattggatgtgtcttatgtcctgggtttttgtatagggaacgatttgtgtcacatggtctctgggtcccacttgcaaacttgtgtttttcttctcagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1629 - DNA, 1336 bp, Homo sapiens
ggtcctcccgcatcagccttttgagatgggaggattgcttgagcccaggagttcgaggctgcagtgagctatgattccaccattgcactgcagcctgggtgacagcaagaacctgtctctttaagaaaaaaaaaagaataaaaaaggaagaaagaaaagttggcagctggtgtcatgattgttctcctgaatttgtgtcatgaaggactggagagaaccaattcccacaagtgtgatggcagcccttgtagatcgtggttttccatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1630 - DNA, 1525 bp, Homo sapiens
aaggcgatttttgaagcatctgggtagatctgggcagtgaatgcattttcgaggccacttaggaaggggaggcccgctcagaaacaggggtgatggttcgggccctgttttgtcttggagggtcactgagggctcaggaaaccatggcttccaccgggaaaaggcaagggcaggtgtgggtgacctctggagccatcaggaggctttcattgggaagatgtaggggtcgacattgtaccagaggcagagcctcatgccactgcggagaatgctgcagggaggacggagtccccagcaccatgcacctgcctgctggagtagcctgaccccttgtttagggtgtcaggctgaggctgggggaccttttgtagggaaggccagttcctactccggggtggaggtgggaattggcccaaaagacctcccagttctaaagtgaattccaagtggttctgggcaactgaccccccaagtgatctaagacagatgacttgtgactttaaagctgtccccaagtgagcatccttcacaggcccttggttgctctcttgttcatctgtcttatgtttgggaaatttatcttcctggtgccggaagcacttctctttgatggtgagaggagcattccccaaactcatcctggttgctggagaatttgatgaaaacaacaggttgagaagttttacccatagattgcctggaagtcggtctgttggggcctccccgctcacattgtcccttctagcccctgaccgcctttcctttccctttggccaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 1631 - DNA, 1061 bp, Homo sapiens
aaggcgatttttgaagcatctgggtagatctgggcagtgaatgcattttcgaggccacttaggaaggggaggcccgctcagaaacaggggtgatggttcgggccctgttttgtcttggagggtcactgagggctcaggaaaccatggcttccaccgggaaaaggcaagggcaggtgtgggtgacctctggagccatcaggaggctttcattgggaagatgtaggggtcgacattgtaccagaggcagagcctcatgccactgcggagaatgctgcagggaggacggagtccccagcaccatgcacctgcctgctggagtagcctgaccccttgtttagggtgtcaggctgaggctgggggaccttttgtagggaaggccagttcctactccggggtggaggtgggaattggcccaaaagacctcccagttctaaagtgaattccaagtggttctgggcaactgaccccccaagtgatctaagacagatgacttgtgactttaaagctgtccccaagtgagcatccttcacaggcccttggttgctctcttgttcatctgtcttatgtttgggaaatttatcttcctggtgccggaagcacttctctttgatggtgagaggagcattccccaaactcatcctggttgctggagaatttgatgaaaacaacaggttgagaagttttacccatagattgcctggaagtcggtctgttggggcctccccgctcacattgtcccttctagcccctgaccgcctttcctttccctttggccaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggtcggtgagaatgtagaaatgcctctgtcctcaagaatgtggcccatagtggccgggtgctgtgggccacacctgtaatcccagcactt

SEQ ID NO: 1632 - DNA, 130 bp, Artificial Sequence
  Synthetic oligonucleotide
gaagaggaggcgcgagaatggaggtggaggccgtctgtggtggcgcgggcgaggtggaggcccaggactctgaccctgcccctgccttcagcaaggcccccggcagcgccggccactacgaactgccgtg

SEQ ID NO: 1633 - DNA, 263 bp, Artificial Sequence
  Synthetic oligonucleotide
ggtcctcccgcatcagccttttgagatgggaggattgcttgagcccaggagttcgaggctgcagtgagctatgattccaccattgcactgcagcctgggtgacagcaagaacctgtctctttaagaaaaaaaaaagaataaaaaaggaagaaagaaaagttggcagctggtgtcatgattgttctcctgaatttgtgtcatgaaggactggagagaaccaattcccacaagtgtgatggcagcccttgtagatcgtggttttc

SEQ ID NO: 1634 - DNA, 230 bp, Artificial Sequence
  Synthetic oligonucleotide
gtgagtttcacttgagggttgttctgatgctgtaggtactaaatgctgtttgcacagtctttgagagagcggcctgcaggtgttagcattagagggatggcctgcgtacttccaatgagaccctcatttaggacattggatgtgtcttatgtcctgggtttttgtatagggaacgatttgtgtcacatggtctctgggtcccacttgcaaacttgtgtttttcttctcag

SEQ ID NO: 1635 - DNA, 158 bp, Artificial Sequence
  Synthetic oligonucleotide
agcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcag

SEQ ID NO: 1636 - DNA, 777 bp, Artificial Sequence
  Synthetic oligonucleotide
aaggcgatttttgaagcatctgggtagatctgggcagtgaatgcattttcgaggccacttaggaaggggaggcccgctcagaaacaggggtgatggttcgggccctgttttgtcttggagggtcactgagggctcaggaaaccatggcttccaccgggaaaaggcaagggcaggtgtgggtgacctctggagccatcaggaggctttcattgggaagatgtaggggtcgacattgtaccagaggcagagcctcatgccactgcggagaatgctgcagggaggacggagtccccagcaccatgcacctgcctgctggagtagcctgaccccttgtttagggtgtcaggctgaggctgggggaccttttgtagggaaggccagttcctactccggggtggaggtgggaattggcccaaaagacctcccagttctaaagtgaattccaagtggttctgggcaactgaccccccaagtgatctaagacagatgacttgtgactttaaagctgtccccaagtgagcatccttcacaggcccttggttgctctcttgttcatctgtcttatgtttgggaaatttatcttcctggtgccggaagcacttctctttgatggtgagaggagcattccccaaactcatcctggttgctggagaatttgatgaaaacaacaggttgagaagttttacccatagattgcctggaagtcggtctgttggggcctccccgctcacattgtcccttctagcccctgaccgcctttcctttccctttggccag

SEQ ID NO: 1637 - DNA, 120 bp, Artificial Sequence
  Synthetic oligonucleotide
gaactgccaaacggttttccgaagtggctgcagcacgtgcattcccaccagcattccggaggatcctcaacctagccaccacatggagtgctcagtttggtttttaagccattctaatag

SEQ ID NO: 1638 - DNA, 193 bp, Artificial Sequence
  Synthetic oligonucleotide
gaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgc

SEQ ID NO: 1639 - DNA, 218 bp, Artificial Sequence
  Synthetic oligonucleotide
ctttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccag

SEQ ID NO: 1640 - DNA, 223 bp, Artificial Sequence
  Synthetic oligonucleotide
cctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggca

SEQ ID NO: 1641 - DNA, 40 bp, Artificial Sequence
  Synthetic oligonucleotide
cttgcgtggcggcgtcaaggggcggtgcctcgggtggcgg

SEQ ID NO: 1642 - DNA, 70 bp, Artificial Sequence
  Synthetic oligonucleotide
ggttgaaaaatataggccagtaaagctgaatgaaattgtcgggaatgaagacaccgtgagcaggctagag

SEQ ID NO: 1643 - DNA, 49 bp, Artificial Sequence
  Synthetic oligonucleotide
tcatccagaagcaagttttaaccggttttaatgatcattttcgccgtag

SEQ ID NO: 1644 - DNA, 42 bp, Artificial Sequence
  Synthetic oligonucleotide
gtctttgcaagggaaggaaatgtgcccaacatcatcattgcg

SEQ ID NO: 1645 - DNA, 102 bp, Artificial Sequence
  Synthetic oligonucleotide
gggtcagaggtgacggagatgcaaacagcagtgaacataactcaagagctacctgaggtccttctggtggtttgaagtctttactggagatctcattcccag

SEQ ID NO: 1646 - DNA, 73 bp, Artificial Sequence
  Synthetic oligonucleotide
ggccctccaggaaccggcaagaccacaagcattctgtgcttggcccgggccctgctgggcccagcactcaaag

SEQ ID NO: 1647 - DNA, 34 bp, Artificial Sequence
  Synthetic oligonucleotide
atgccatgttggaactcaatgcttcaaatgacag

SEQ ID NO: 1648 - DNA, 102 bp, Artificial Sequence
  Synthetic oligonucleotide
gggcattgacgttgtgaggaataaaattaaaatgtttgctcaacaaaaagtcactcttcccaaaggccgacataagatcatcattctggatgaagcagacag

SEQ ID NO: 1649 - DNA, 101 bp, Artificial Sequence
  Synthetic oligonucleotide
catgaccgacggagcccagcaagccttgaggagaaccatggaaatctactctaaaaccactcgcttcgcccttgcttgtaatgcttcggataagatcatcg

SEQ ID NO: 1650 - DNA, 66 bp, Artificial Sequence
  Synthetic oligonucleotide
gcgctgaacaacctgcagtccaccttctcaggatttggcttcattaacagtgagaacgtgttcaag

SEQ ID NO: 1651 - DNA, 81 bp, Artificial Sequence
  Synthetic oligonucleotide
gtctgtgacgagccccacccactgctggtaaaggagatgatccagcactgtgtgaatgccaacattgacgaagcctacaag

SEQ ID NO: 1652 - DNA, 114 bp, Artificial Sequence
  Synthetic oligonucleotide
attcttgctcacttgtggcatctgggctactcaccagaagatatcattggcaacatctttcgagtgtgtaaaactttccaaatggcagaatacctgaaactggagtttatcaag

SEQ ID NO: 1653 - DNA, 89 bp, Artificial Sequence
  Synthetic oligonucleotide
gtcggtgagaatgtagaaatgcctctgtcctcaagaatgtggcccatagtggccgggtgctgtgggccacacctgtaatcccagcactt

SEQ ID NO: 1654 - DNA, 22 bp, Artificial Sequence
  Synthetic oligonucleotide
cttaggctggagccaacatgac

SEQ ID NO: 1655 - DNA, 58 bp, Artificial Sequence
  Synthetic oligonucleotide
tgtcctttaaactccagtggctggccaggcacggtagctcacgcctgtaatcccaaca

SEQ ID NO: 1656 - DNA, 3728 bp, Homo sapiens
tcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctcttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 1657 - DNA, 3579 bp, Homo sapiens
tcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctcttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 1658 - DNA, 3031 bp, Homo sapiens
cgccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggaagtaggagtcaaagtgacccttgtctactgtgatgctgaattcatgactaagagactattggtgaacttatcctggctgtgattacagacgtcaagagggagtattccagcgacactaagaaaataatgcaagagaacgccagcgaagagtgcccaggcaacactgacagactagaaaaaaaatatcaggagatgaagctgacacagtgagagcagcccaggtgcttcttggtgcttgttattacagacacacacttcacacaggggaggattattttaattctgtggccttcagatctcataaatacaagtaaaaacaagcaggtaactatgataactttacttcagagagtttaaatttcaaaaataaacctatccatccagcccctt

SEQ ID NO: 1659 - DNA, 1882 bp, Homo sapiens
cgccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtaagtatatgtatctattctgagtcttgtgtatagcatctgcagttctaattagattacttttcttaggaaaaggtggtagaactttaactactgaaaataaatggtcctattcagtttgcagccaagatttacattcagagtacctgtcatctggattgtagctaaatatttaaggctagtttaggtagagttcttattatccatcaaaaatgatggcatatgttttgcttaataaaatttgtttgtaatttcagttttgagtaaacctaagatttgctaacagagctgtgaatttataggagaaatgacaaattctaatatagtacagttttatgtaaagtgattgctttattagtagatgctcatgagcagtttttgttttgttttaacttttaggttccgggtaatgtgcaggcttgttatataggtaaattgcatgtcacaggggtttcgtgtgcagattattttgtcacccaggcagtaagtattgtacccaataggtagtttttcagttctt

SEQ ID NO: 1660 - DNA, 233 bp, Artificial Sequence
  Synthetic oligonucleotide
cgccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgag

SEQ ID NO: 1661 - DNA, 226 bp, Artificial Sequence
  Synthetic oligonucleotide
tcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcag

SEQ ID NO: 1662 - DNA, 180 bp, Artificial Sequence
  Synthetic oligonucleotide
ctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctg

SEQ ID NO: 1663 - DNA, 149 bp, Artificial Sequence
  Synthetic oligonucleotide
atattgatggacagtatgcaatgactcgagctcagagggtacgagctgctatgttccctgagacattagatgagggcatgcagatcccatctacacagtttgatgctgctcatcccactaatgtccagcgtttggctgaaccatcacag

SEQ ID NO: 1664 - DNA, 239 bp, Artificial Sequence
  Synthetic oligonucleotide
gtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttgg

SEQ ID NO: 1665 - DNA, 202 bp, Artificial Sequence
  Synthetic oligonucleotide
ttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaag

SEQ ID NO: 1666 - DNA, 145 bp, Artificial Sequence
  Synthetic oligonucleotide
ctcatcatactggctagtggtggaccccaagctttagtaaatataatgaggacctatacttacgaaaaactactgtggaccacaagcagagtgctgaaggtgctatctgtctgctctagtaataagccggctattgtagaagctg

SEQ ID NO: 1667 - DNA, 520 bp, Artificial Sequence
  Synthetic oligonucleotide
gtaagtatatgtatctattctgagtcttgtgtatagcatctgcagttctaattagattacttttcttaggaaaaggtggtagaactttaactactgaaaataaatggtcctattcagtttgcagccaagatttacattcagagtacctgtcatctggattgtagctaaatatttaaggctagtttaggtagagttcttattatccatcaaaaatgatggcatatgttttgcttaataaaatttgtttgtaatttcagttttgagtaaacctaagatttgctaacagagctgtgaatttataggagaaatgacaaattctaatatagtacagttttatgtaaagtgattgctttattagtagatgctcatgagcagtttttgttttgttttaacttttaggttccgggtaatgtgcaggcttgttatataggtaaattgcatgtcacaggggtttcgtgtgcagattattttgtcacccaggcagtaagtattgtacccaataggtagtttttcagttctt

SEQ ID NO: 1668 - DNA, 339 bp, Artificial Sequence
  Synthetic oligonucleotide
gaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaag

SEQ ID NO: 1669 - DNA, 159 bp, Artificial Sequence
  Synthetic oligonucleotide
gctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtg

SEQ ID NO: 1670 - DNA, 120 bp, Artificial Sequence
  Synthetic oligonucleotide
gagggggtccgcatggaagaaatagttgaaggttgtaccggagcccttcacatcctagctcgggatgttcacaaccgaattgttatcagaggactaaataccattccattgtttgtgcag

SEQ ID NO: 1671 - DNA, 145 bp, Artificial Sequence
  Synthetic oligonucleotide
ctgctttattctcccattgaaaacatccaaagagtagctgcaggggtcctctgtgaacttgctcaggacaaggaagctgcagaagctattgaagctgagggagccacagctcctctgacagagttacttcactctaggaatgaag

SEQ ID NO: 1672 - DNA, 122 bp, Artificial Sequence
  Synthetic oligonucleotide
cgacatatgcagctgctgttttgttccgaatgtctgaggacaagccacaagattacaagaaacggctttcagttgagctgaccagctctctcttcagaacagagccaatggcttggaatgag

SEQ ID NO: 1673 - DNA, 221 bp, Artificial Sequence
  Synthetic oligonucleotide
atcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttag

SEQ ID NO: 1674 - DNA, 305 bp, Artificial Sequence
  Synthetic oligonucleotide
gtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacag

SEQ ID NO: 1675 - DNA, 153 bp, Artificial Sequence
  Synthetic oligonucleotide
ctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttg

SEQ ID NO: 1676 - DNA, 435 bp, Artificial Sequence
  Synthetic oligonucleotide
cagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 1677 - DNA, 153 bp, Artificial Sequence
  Synthetic oligonucleotide
gaagtaggagtcaaagtgacccttgtctactgtgatgctgaattcatgactaagagactattggtgaacttatcctggctgtgattacagacgtcaagagggagtattccagcgacactaagaaaataatgcaagagaacgccagcgaagagt

SEQ ID NO: 1678 - DNA, 239 bp, Artificial Sequence
  Synthetic oligonucleotide
gcccaggcaacactgacagactagaaaaaaaatatcaggagatgaagctgacacagtgagagcagcccaggtgcttcttggtgcttgttattacagacacacacttcacacaggggaggattattttaattctgtggccttcagatctcataaatacaagtaaaaacaagcaggtaactatgataactttacttcagagagtttaaatttcaaaaataaacctatccatccagcccctt

SEQ ID NO: 1679 - DNA, 61 bp, Artificial Sequence
  Synthetic oligonucleotide
ggtatttgaagtataccatacaactgttttgaaaatccagcgtggacaatggctactcaag

SEQ ID NO: 1680 - DNA, 48 bp, Artificial Sequence
  Synthetic oligonucleotide
ctgatttgatggagttggacatggccatggaaccagacagaaaagcgg

SEQ ID NO: 1681 - DNA, 105 bp, Artificial Sequence
  Synthetic oligonucleotide
atgctgaaacatgcagttgtaaacttgattaactatcaagatgatgcagaacttgccacacgtgcaatccctgaactgacaaaactgctaaatgacgaggaccag

SEQ ID NO: 1682 - DNA, 96 bp, Artificial Sequence
  Synthetic oligonucleotide
gtggaatgcaagctttaggacttcacctgacagatccaagtcaacgtcttgttcagaactgtctttggactctcaggaatctttcagatgctgcaa

SEQ ID NO: 1683 - DNA, 8 bp, Artificial Sequence
  Synthetic oligonucleotide
ctaaacag

SEQ ID NO: 1684 - DNA, 6 bp, Artificial Sequence
  Synthetic oligonucleotide
gtgtgg

SEQ ID NO: 1685 - DNA, 61 bp, Artificial Sequence
  Synthetic oligonucleotide
actgctgatcttggacttgatattggtgcccagggagaaccccttggatatcgccaggatg

SEQ ID NO: 1686 - DNA, 6 bp, Artificial Sequence
  Synthetic oligonucleotide
gtcgag

SEQ ID NO: 1687 - DNA, 34 bp, Artificial Sequence
  Synthetic oligonucleotide
gagtaacaatacaaatggattttgggagtgactc

SEQ ID NO: 1688 - DNA, 86 bp, Artificial Sequence
  Synthetic oligonucleotide
aagaagtgaagaatgcacaagaatggatcacaagatggaatttatcaaaccctagccttgcttgttaaattttttttttttttttt

SEQ ID NO: 1689 - DNA, 45 bp, Artificial Sequence
  Synthetic oligonucleotide
ttaagaatatctgtaatggtactgactttgcttgctttgaagtag

SEQ ID NO: 1690 - DNA, 19 bp, Artificial Sequence
  Synthetic oligonucleotide
ctctttttttttttttttt

SEQ ID NO: 1691 - DNA, 13 bp, Artificial Sequence
  Synthetic oligonucleotide
ttttttttttttg

SEQ ID NO: 1692 - DNA, 5947 bp, Homo sapiens
gagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggattgctgggaggagtaataactataaaatgataatgacaataatggccaacattttttgagggcttacttaccaaggaacagtcctaagtgctttacttctgttacctcatttaatcctcaaaacacctcaatgagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttctttt

SEQ ID NO: 1693 - DNA, 6040 bp, Homo sapiens
attttctctcattcttttccactaaagtgcgactaaagtcacaggagattgaatacatgctttggaagtatggcatcaaagtgcgcatagacctgccacatatttgaaatttctcctaagacgtattttattgtgaagaattatgaaaaatgttctattctagaattgattagtgtgagttcttaagttcctaatttatagactgaggataataatagcatttaccttttaggattgctgggaggagtaataactataaaatgataatgacaataatggccaacattttttgagggcttacttaccaaggaacagtcctaagtgctttacttctgttacctcatttaatcctcaaaacacctcaatgagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttctttt

SEQ ID NO: 1694 - DNA, 5777 bp, Homo sapiens
gagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgtgccatataactcaccccttcttgtgggccggctccaggtcaccagcatagtccatagtgggagctggtgatgcatgacactggaggacctgaaaatggggtctagctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttctttt

SEQ ID NO: 1695 - DNA, 5361 bp, Homo sapiens
taggtacacatcttacagtttataaactttacttttagagcacttgtgacttactactaaattttgtttgtttttcttttagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgtgccatataactcaccccttcttgtgggccggctccaggtcaccagcatagtccatagtgggagctggtgatgcatgacactggaggacctgaaaatggggtctagctcgatacagaaaccagaccagccaggcagagtcctactataggcatgcagctcagcttgtcccctccaatgaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttctttt

SEQ ID NO: 1696 - DNA, 935 bp, Homo sapiens
gagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggattgctgggaggagtaataactataaaatgataatgacaataatggccaacattttttgagggcttacttaccaaggaacagtcctaagtgctttacttctgttacctcatttaatcctcaaaacacctcaatgagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacaggtattggctggcttatttctttttcacaacatattttatatattaaattaatggaaggatatcctctttcttatattatgcacagcactaaatcccatcttagttgccaaaagggatgatcatttactatctgctttaaatatttattgtttatgtagtttgaattcttgcttaaataactgttgggaattgcatgtaatactaatatatggtatactgaattgaatgttacctaatttagtttatataatcacttaatttttatgaaactttttattaatgatttaagacatacagaaaaaataacataccccatataaaccaaaatatcttacagtgttaggctaatatctttctgggaaatttttttttctattaataattaaccaaactttagtaggtaaaccttcagaaaaaatatttatagaaaaattctattggaagtccttgaaattgagtgagctaccttgctgcctttcttttctccc

SEQ ID NO: 1697 - DNA, 477 bp, Homo sapiens
gagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctgtaagtattacctatcatttgagaagtccctgtaagatcaagaatttcaccgagactttaaaacagtttggttcgttatttatttttcaacctgttgcagaataaactttttcaatggaaagtaattctagtatttgtgatatttggccattggtattatttcaaatacagtctttggaggaggtaag

SEQ ID NO: 1698 - DNA, 691 bp, Homo sapiens
taaacagaccaacttgacagtctgttatttcaaatgggttggcttactgtaaggcatatagtttcctgttatatgaaaaggcagaaatacaaacaaaaagcaaagggcaaaccattcttttttttttttttttttagcccttttcatttcatgatattatttcaaaactaaaaacagaagcattgtaaaccagacttagtcattagtcaaaagttgaaagtcatttgaaatatagtagtataaaacttctgcagcattctatggaatatatttagagcaggttttgccttggggatagagcaggaaggagtcactggtgtggtataatggttttaactgctggggtttatctatctaccgttatgtttttgtttttgttactcagattctaagctgggtccagctgaagtctggacatccaggcaggctctgcaggacctgtaccagaaaatgctagttaccgatttggaatacgctttagacaagaaagtagaacaggatctgtaagtattacctatcatttgagaagtccctgtaagatcaagaatttcaccgagactttaaaacagtttggttcgttatttatttttcaacctgttgcagaataaactttttcaatggaaagtaattctagtatttgtgatatttggccattggtattatttcaaatacagtctttggaggaggtaag

SEQ ID NO: 1699 - DNA, 139 bp, Artificial Sequence
  Synthetic oligonucleotide
gagaggaagatggcggcggccgccagcacccgcggtgccgcggggccgctccgaggagcctgagagacccacggaggcttcgcgggaagacgcggcggcggcggcggaggatgagcctgcagagcgcgcagtacctccg

SEQ ID NO: 1700 - DNA, 232 bp, Artificial Sequence
  Synthetic oligonucleotide
attttctctcattcttttccactaaagtgcgactaaagtcacaggagattgaatacatgctttggaagtatggcatcaaagtgcgcatagacctgccacatatttgaaatttctcctaagacgtattttattgtgaagaattatgaaaaatgttctattctagaattgattagtgtgagttcttaagttcctaatttatagactgaggataataatagcatttaccttttag

SEQ ID NO: 1701 - DNA, 137 bp, Artificial Sequence
  Synthetic oligonucleotide
gattgctgggaggagtaataactataaaatgataatgacaataatggccaacattttttgagggcttacttaccaaggaacagtcctaagtgctttacttctgttacctcatttaatcctcaaaacacctcaatgag

SEQ ID NO: 1702 - DNA, 139 bp, Artificial Sequence
  Synthetic oligonucleotide
aatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattag

SEQ ID NO: 1703 - DNA, 488 bp, Artificial Sequence
  Synthetic oligonucleotide
gtattggctggcttatttctttttcacaacatattttatatattaaattaatggaaggatatcctctttcttatattatgcacagcactaaatcccatcttagttgccaaaagggatgatcatttactatctgctttaaatatttattgtttatgtagtttgaattcttgcttaaataactgttgggaattgcatgtaatactaatatatggtatactgaattgaatgttacctaatttagtttatataatcacttaatttttatgaaactttttattaatgatttaagacatacagaaaaaataacataccccatataaaccaaaatatcttacagtgttaggctaatatctttctgggaaatttttttttctattaataattaaccaaactttagtaggtaaaccttcagaaaaaatatttatagaaaaattctattggaagtccttgaaattgagtgagctaccttgctgcctttcttttctccc

SEQ ID NO: 1704 - DNA, 385 bp, Artificial Sequence
  Synthetic oligonucleotide
taaacagaccaacttgacagtctgttatttcaaatgggttggcttactgtaaggcatatagtttcctgttatatgaaaaggcagaaatacaaacaaaaagcaaagggcaaaccattcttttttttttttttttttagcccttttcatttcatgatattatttcaaaactaaaaacagaagcattgtaaaccagacttagtcattagtcaaaagttgaaagtcatttgaaatatagtagtataaaacttctgcagcattctatggaatatatttagagcaggttttgccttggggatagagcaggaaggagtcactggtgtggtataatggttttaactgctggggtttatctatctaccgttatgtttttgtttttgttactcag

SEQ ID NO: 1705 - DNA, 188 bp, Artificial Sequence
  Synthetic oligonucleotide
gtaagtattacctatcatttgagaagtccctgtaagatcaagaatttcaccgagactttaaaacagtttggttcgttatttatttttcaacctgttgcagaataaactttttcaatggaaagtaattctagtatttgtgatatttggccattggtattatttcaaatacagtctttggaggaggtaag

SEQ ID NO: 1706 - DNA, 133 bp, Artificial Sequence
  Synthetic oligonucleotide
ctggaatcacgcctttaagaatcagatcacaacactacaaggccaggcaaagaatcgagcaaatccgaatcggagtgaagttcaggcaaacctttctctgttcctagaggcagctagtggcttctatactcag

SEQ ID NO: 1707 - DNA, 172 bp, Artificial Sequence
  Synthetic oligonucleotide
ttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattg

SEQ ID NO: 1708 - DNA, 136 bp, Artificial Sequence
  Synthetic oligonucleotide
ccgagatgaggtgaaaaccaagtggggtgtttctgacttcatcaaggcctttattaaattccacggtcatgtgtacctgagtaagagcttggaaaagttgagccctcttcgagagaaattggaagaacagtttaag

SEQ ID NO: 1709 - DNA, 163 bp, Artificial Sequence
  Synthetic oligonucleotide
aggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctcttta

SEQ ID NO: 1710 - DNA, 157 bp, Artificial Sequence
  Synthetic oligonucleotide
tgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagta

SEQ ID NO: 1711 - DNA, 120 bp, Artificial Sequence
  Synthetic oligonucleotide
gaacttggatttttccaaaggtcaccagggtattacaggggacaaagaaggccagcaacgacgaatacgacagcaacgcttgatctctataggcaaatggattgctgataatcagccaag

SEQ ID NO: 1712 - DNA, 289 bp, Artificial Sequence
  Synthetic oligonucleotide
gctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagag

SEQ ID NO: 1713 - DNA, 145 bp, Artificial Sequence
  Synthetic oligonucleotide
gtaaaatcccagacagaactaagaaagactccagtgtctgaagccagaaaaacacctgtaactcaaaccccaactcaagcaagtaactcccagttcatccccattcatcaccctggagccttccctcctcttcccagcaggccag

SEQ ID NO: 1714 - DNA, 383 bp, Artificial Sequence
  Synthetic oligonucleotide
ggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcag

SEQ ID NO: 1715 - DNA, 372 bp, Artificial Sequence
  Synthetic oligonucleotide
tatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgag

SEQ ID NO: 1716 - DNA, 160 bp, Artificial Sequence
  Synthetic oligonucleotide
gaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcag

SEQ ID NO: 1717 - DNA, 171 bp, Artificial Sequence
  Synthetic oligonucleotide
atcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccag

SEQ ID NO: 1718 - DNA, 146 bp, Artificial Sequence
  Synthetic oligonucleotide
ccatgggtgggtttggcattgattatctctcagcaacgtcatcctctgagagcagttggcatcaggccagcactccgagtggcacctggacaggccatggcccttccatggaggattcctctgctgtcctcatggaaagcctaaag

SEQ ID NO: 1719 - DNA, 1895 bp, Artificial Sequence
  Synthetic oligonucleotide
tctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatg

SEQ ID NO: 1720 - DNA, 423 bp, Artificial Sequence
  Synthetic oligonucleotide
tacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttctttt

SEQ ID NO: 1721 - DNA, 32 bp, Artificial Sequence
  Synthetic oligonucleotide
gcaggcagaagtcctgaaggctgacatgacag

SEQ ID NO: 1722 - DNA, 118 bp, Artificial Sequence
  Synthetic oligonucleotide
attctaagctgggtccagctgaagtctggacatccaggcaggctctgcaggacctgtaccagaaaatgctagttaccgatttggaatacgctttagacaagaaagtagaacaggatct

SEQ ID NO: 1723 - DNA, 82 bp, Artificial Sequence
  Synthetic oligonucleotide
taggtacacatcttacagtttataaactttacttttagagcacttgtgacttactactaaattttgtttgtttttcttttag

SEQ ID NO: 1724 - DNA, 106 bp, Artificial Sequence
  Synthetic oligonucleotide
tgccatataactcaccccttcttgtgggccggctccaggtcaccagcatagtccatagtgggagctggtgatgcatgacactggaggacctgaaaatggggtctag

SEQ ID NO: 1725 - DNA, 72 bp, Artificial Sequence
  Synthetic oligonucleotide
ctcgatacagaaaccagaccagccaggcagagtcctactataggcatgcagctcagcttgtcccctccaatg

SEQ ID NO: 1726 - DNA, 76 bp, Artificial Sequence
  Synthetic oligonucleotide
gtcagccttataatcagttggctatcttagcttcttccaaaggagaccatctgaccacaattttctactactgcag

SEQ ID NO: 1727 - DNA, 75 bp, Artificial Sequence
  Synthetic oligonucleotide
aagcattgctgtgaagttccctttcccagctgcctccactaatctgcaaaaagcactttctaaagcactggaaag

SEQ ID NO: 1728 - DNA, 71 bp, Artificial Sequence
  Synthetic oligonucleotide
catttggccctggttgatttctcttctgaatagtttccatccccatgaagaggacctctcaagtattagtg

SEQ ID NO: 1729 - DNA, 61 bp, Artificial Sequence
  Synthetic oligonucleotide
cgacaccacttccagaggagtttgaattacaaggatttttggcattgagaccttctttcag

SEQ ID NO: 1730 - DNA, 81 bp, Artificial Sequence
  Synthetic oligonucleotide
aaatccttattggagaagccctcagagctcatgtcacattcatcctctttcctgtccctcaccggattctctctcaatcag

SEQ ID NO: 1731 - DNA, 81 bp, Artificial Sequence
  Synthetic oligonucleotide
gcaatatgaaaccttttgtgcttctcttcagccccttccctgtgtccacctttctctcctcttcccaagcctttttcctac

SEQ ID NO: 1732 - DNA, 6237 bp, Homo sapiens
gcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagccagtgggacacctcacaagtcagctccgatgtcctcaggacaagactgctatagtcaccagtgctttgttgctttctggcgctccggtaggatccaggctcacttggtatatcccctgctgcagattacggtccacttctcccgggagctgctttcaagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactatactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 1733 - DNA, 5938 bp, Homo sapiens
cccctccttggaagccccttcccacgcggattgctgaggaagcctttgtggagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactatactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 1734 - DNA, 5977 bp, Homo sapiens
acatttccaacattgtttgccagttgctgcttaggtgacatggatcagcaacgaagcgtcggtttcagtggtttctttttctggactccgagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactatactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 1735 - DNA, 6591 bp, Homo sapiens
gcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggtgggcctggagcccctggtggcacagcatggggggcctggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacagtggtcccacctctcagagtcttggtgccagcctgatccagtgatgtgtggtaggcaggcagagccgcacaggagcccataagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactatactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 1736 - DNA, 192 bp, Artificial Sequence
  Synthetic oligonucleotide
gcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaag

SEQ ID NO: 1737 - DNA, 158 bp, Artificial Sequence
  Synthetic oligonucleotide
ccagtgggacacctcacaagtcagctccgatgtcctcaggacaagactgctatagtcaccagtgctttgttgctttctggcgctccggtaggatccaggctcacttggtatatcccctgctgcagattacggtccacttctcccgggagctgctttca

SEQ ID NO: 1738 - DNA, 230 bp, Artificial Sequence
  Synthetic oligonucleotide
cgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgg

SEQ ID NO: 1739 - DNA, 178 bp, Artificial Sequence
  Synthetic oligonucleotide
ggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgct

SEQ ID NO: 1740 - DNA, 148 bp, Artificial Sequence
  Synthetic oligonucleotide
gctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggag

SEQ ID NO: 1741 - DNA, 182 bp, Artificial Sequence
  Synthetic oligonucleotide
cccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaag

SEQ ID NO: 1742 - DNA, 168 bp, Artificial Sequence
  Synthetic oligonucleotide
gtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgag

SEQ ID NO: 1743 - DNA, 126 bp, Artificial Sequence
  Synthetic oligonucleotide
caggggccgatcctgacaaagcacggcaagaacccagtcatggagctgaacgagaagaggcgtgggctcaagtacgagctcatctccgagaccgggggcagccacgacaagcgcttcgtcatggag

SEQ ID NO: 1744 - DNA, 177 bp, Artificial Sequence
  Synthetic oligonucleotide
gtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaag

SEQ ID NO: 1745 - DNA, 154 bp, Artificial Sequence
  Synthetic oligonucleotide
ccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccg

SEQ ID NO: 1746 - DNA, 239 bp, Artificial Sequence
  Synthetic oligonucleotide
ctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaact

SEQ ID NO: 1747 - DNA, 129 bp, Artificial Sequence
  Synthetic oligonucleotide
actacagtggtagtggaggccgaagcggcgggaacagctacggctcaggcggggcatcctacaacccagggtcacacgggggctacggcggaggttctgggggcggctcctcataccaaggcaaacaag

SEQ ID NO: 1748 - DNA, 500 bp, Artificial Sequence
  Synthetic oligonucleotide
gtgggcctggagcccctggtggcacagcatggggggcctggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacagtggtcccacctctcagagtcttggtgccagcctgatccagtgatgtgtggtaggcaggcagagccgcacaggagcccataagtcttgcccacctgcatcctggccgaggcttgggtgtgggctgcctaacctgagccccgctggctgggcccctcggctctaatccaccactctctctcctag

SEQ ID NO: 1749 - DNA, 179 bp, Artificial Sequence
  Synthetic oligonucleotide
gaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccat

SEQ ID NO: 1750 - DNA, 386 bp, Artificial Sequence
  Synthetic oligonucleotide
tgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggc

SEQ ID NO: 1751 - DNA, 358 bp, Artificial Sequence
  Synthetic oligonucleotide
ctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcatac

SEQ ID NO: 1752 - DNA, 540 bp, Artificial Sequence
  Synthetic oligonucleotide
cagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactatactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttag

SEQ ID NO: 1753 - DNA, 393 bp, Artificial Sequence
  Synthetic oligonucleotide
agcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagac

SEQ ID NO: 1754 - DNA, 267 bp, Artificial Sequence
  Synthetic oligonucleotide
ccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcag

SEQ ID NO: 1755 - DNA, 455 bp, Artificial Sequence
  Synthetic oligonucleotide
gtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccacc

SEQ ID NO: 1756 - DNA, 183 bp, Artificial Sequence
  Synthetic oligonucleotide
cttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 1757 - DNA, 51 bp, Artificial Sequence
  Synthetic oligonucleotide
cccctccttggaagccccttcccacgcggattgctgaggaagcctttgtgg

SEQ ID NO: 1758 - DNA, 90 bp, Artificial Sequence
  Synthetic oligonucleotide
acatttccaacattgtttgccagttgctgcttaggtgacatggatcagcaacgaagcgtcggtttcagtggtttctttttctggactccg

SEQ ID NO: 1759 - DNA, 70 bp, Artificial Sequence
  Synthetic oligonucleotide
agttgaagtattgataacaccaaggaactctatcacaatttgaaaagataagcaaaagtttgatttccag

SEQ ID NO: 1760 - DNA, 23 bp, Artificial Sequence
  Synthetic oligonucleotide
acactacagaagaagtaaaaatg

SEQ ID NO: 1761 - DNA, 92 bp, Artificial Sequence
  Synthetic oligonucleotide
aaacgctatcagtcaacgaccccccggacgttctggacaggcagaaatgccttgctgccttggcgtccctccgacacgccaagtggttccag

SEQ ID NO: 1762 - DNA, 96 bp, Artificial Sequence
  Synthetic oligonucleotide
gccagagccaacgggctgaagtcttgtgtcattgtgatccgggtcttgagggacctgtgcactcgcgtgcccacctggggtcccctccgaggctgg

SEQ ID NO: 1763 - DNA, 112 bp, Artificial Sequence
  Synthetic oligonucleotide
cctctcgagctcctgtgtgagaaatccattggcacggccaacagaccgatgggtgctggcgaggccctgcggagagtgctggagtgcctggcgtcgggcatcgtgatgccag

SEQ ID NO: 1764 - DNA, 98 bp, Artificial Sequence
  Synthetic oligonucleotide
atggttctggcatttatgacccttgtgaaaaagaagccactgatgctattgggcatctagacagacagcaacgggaagatatcacacagagtgcgcag

SEQ ID NO: 1765 - DNA, 112 bp, Artificial Sequence
  Synthetic oligonucleotide
cacgcactgcggctcgctgccttcggccagctccataaagtcctaggcatggaccctctgccttccaagatgcccaagaaaccaaagaatgaaaacccagtggactacaccg

SEQ ID NO: 1766 - DNA, 22 bp, Artificial Sequence
  Synthetic oligonucleotide
ttcagatcccaccaagcaccac

SEQ ID NO: 1767 - DNA, 89 bp, Artificial Sequence
  Synthetic oligonucleotide
ctatgccattacgcccatgaaacgcccaatggaggaggacggggaggagaagtcgcccagcaaaaagaagaagaagattcagaagaaag

SEQ ID NO: 1768 - DNA, 18 bp, Artificial Sequence
  Synthetic oligonucleotide
aggagaaggcagagcccc

SEQ ID NO: 1769 - DNA, 12 bp, Artificial Sequence
  Synthetic oligonucleotide
aacgtaaaacag

SEQ ID NO: 1770 - DNA, 16 bp, Artificial Sequence
  Synthetic oligonucleotide
gtgctgggtatggaag

SEQ ID NO: 1771 - DNA, 38 bp, Artificial Sequence
  Synthetic oligonucleotide
ctatgggtacggaggcaactcggcgacagcaggctaca

SEQ ID NO: 1772 - DNA, 76 bp, Artificial Sequence
  Synthetic oligonucleotide
gtcagttctacagcaacggagggcattctgggaatgccagtggcggtggcggcgggggcggtggtggctcctccgg

SEQ ID NO: 1773 - DNA, 4 bp, Artificial Sequence
  Synthetic oligonucleotide
ctcc

SEQ ID NO: 1774 - DNA, 44 bp, Artificial Sequence
  Synthetic oligonucleotide
cgggggcgggggcggatccgactacaactacgagagcaaattca

SEQ ID NO: 1775 - DNA, 19 bp, Artificial Sequence
  Synthetic oligonucleotide
cagaagatcgagttttatg

SEQ ID NO: 1776 - DNA, 25 bp, Artificial Sequence
  Synthetic oligonucleotide
catcacagttaacatgtcagctggc

SEQ ID NO: 1777 - DNA, 15 bp, Artificial Sequence
  Synthetic oligonucleotide
cctccaggcccccgc

SEQ ID NO: 1778 - DNA, 31 bp, Artificial Sequence
  Synthetic oligonucleotide
ccccatcccgtccacgttgctgtgtcgtgag

SEQ ID NO: 1779 - DNA, 28 bp, Artificial Sequence
  Synthetic oligonucleotide
gtgcagcgggtcaccctgtggcccgtcc

SEQ ID NO: 1780 - DNA, 52 bp, Artificial Sequence
  Synthetic oligonucleotide
ctgggtgtctgacccaccagcagtgcaatgggcaggtttccccactctattc

SEQ ID NO: 1781 - DNA, 88 bp, Artificial Sequence
  Synthetic oligonucleotide
ctgctcttgggaaagcagcgtgggccatcaggatggtccctggtccttagagagggtccagttcaggcttctagacattttactcatg

SEQ ID NO: 1782 - DNA, 115 bp, Artificial Sequence
  Synthetic oligonucleotide
ctgaatttagtagagctagtaggccctggtcgtcactctgggcagggatgccgtcagccttgagggtcgccacccacctgtgtgttgccctctgtcctggcggggaaacatacac

SEQ ID NO: 1783 - DNA, 19 bp, Artificial Sequence
  Synthetic oligonucleotide
cccttgtctcaccaccaac

SEQ ID NO: 1784 - DNA, 93 bp, Artificial Sequence
  Synthetic oligonucleotide
cttgcttgtgtagtcagcagggctggccctgccccaaggactcactgcatgtacccggacccctaggcctggcctttgcagcatagttgggag

SEQ ID NO: 1785 - DNA, 1630 bp, Homo sapiens
cactagagatgccgcggccccagctgcacacaaaaggaccctggtgtgggggacccttacaaaagaggacggaaacaacatagttttaaaccaataaaccttgacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 1786 - DNA, 1524 bp, Homo sapiens
gcgcccgagcgcccgccaatggcagggcgcggtgcggcgcgccgaggtgggacggcggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaaggttaaattatacccttttaaatactctttttaaatttttctctttctttaaaaacccaaatatctaaaatgttaattttaagatacttgtatatgaagtcctaaattctggagctgattaatggaatgttcatcgaagttgagggtcatggctttactcatgcccagcagatgtgactgcctttcttaatggagatttatttgggttatcaaatgttattgagagtcagtgttctaggtgctgtggagacaagtgtgtaattgttctgttcttgagtaacttataatgtaaaaagggaaatggaagtatgtgtaaatcgtgtcagattacttttatgagagagatctgccagggcaacacttgcaagtgcaaaaaagtatgagagagcagaacccacagacgagacgtatctggtgtgccatgaactacagtgtcagtcaggggctgggctgtggccatggtgagcaaagcaggaaagataacgtgaaggagcctgtagggaccttccccaaccccgtgtaatacaaggtgctctttgttgtttgaccaaacaatgccaagcaaagactcaatgaaggtaagaaagagaggccgggcgcggtggctcacgcctgtaatcccagcactttgggaagccgaggtgggtggat

SEQ ID NO: 1787 - DNA, 1915 bp, Homo sapiens
gcgcccgagcgcccgccaatggcagggcgcggtgcggcgcgccgaggtgggacggcggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagatatttttcaggtaaatatccttttggttgcaaataacaggaaccaaatgtagctggttttaaaagaagagaaaattcactagaacagtactgcaaatcttgagtaacttaagatgaagttgaaggatgaactgaaccttggggcagccctgggaacctcaccagcatgagctcatggacttttcgtctagaggtttgtcattagtgtagcttaacttccacttcccagactctacgtcagttcaaaatctggaggaaaaaaatctgattggcttagcattggtcagttgtctacctgaggccaatcagctctgacccctgacagaagtcttatcctagacacatggccactgagatgtgagatgtccataaccccatggctgccagaggttgaagggtttccttctgtggacagagacatatttgttctctgaaaagaggagtcagaaataaattgcaacagatgtgtactacagcagtattgctaactttggaaacggagccagtattgaatactttatggttttgagaaattgtagatggcttcaaccaaggtcatgttagtatattgcaatggaaataggaccagactgttgtctttgttgactggcttcataaaaactactccttgcctcatgccagtgttgttgtttgtgatatttactcactaaatcagaagactcctcctcccaaacttgcttacatcaaggaggaaaaaaagtcctgatgataataactttattgtatttaaacattagcagattatgataatagctacatagtcattctttgctctgtgcatttgaccattgcagatgttttaatgctataaaagatcctgacttactcatctgtattatttctgtaactgggctatatatctgaaggaagtaatctgtgaaagtttcaagagggcatcagttggttacctttgcaaaaataggaaaaatatggaaaatgtaagtgttttaaaagaaaaacaaatttaaatctttgttcttgaaattcatcatttgcgcaaagtaattttttttgtaaggatgatttggtaaaggataaaagtttccggccgggcacggtggctcacacctgtaatcccagcactttgggaggccgaggcgggcagatcacgaggtcaggagatcaagaccatcctggctaacacggtgaaaccccgtctgtactaaaaatacaaaaaattagctgggcgtggtggtgggcacctgtagtcccagctattcaggaggctgaggcaggagaatggcgtgaacccggaaggcagagcttgcagt

SEQ ID NO: 1788 - DNA, 131 bp, Artificial Sequence
  Synthetic oligonucleotide
gcgcccgagcgcccgccaatggcagggcgcggtgcggcgcgccgaggtgggacggcggcgcgctgaggaggcggtgcgctcaggcggcgctcccggagatgccccgcggcagccgcgctcggggctctaag

SEQ ID NO: 1789 - DNA, 164 bp, Artificial Sequence
  Synthetic oligonucleotide
atgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaag

SEQ ID NO: 1790 - DNA, 1292 bp, Artificial Sequence
  Synthetic oligonucleotide
atatttttcaggtaaatatccttttggttgcaaataacaggaaccaaatgtagctggttttaaaagaagagaaaattcactagaacagtactgcaaatcttgagtaacttaagatgaagttgaaggatgaactgaaccttggggcagccctgggaacctcaccagcatgagctcatggacttttcgtctagaggtttgtcattagtgtagcttaacttccacttcccagactctacgtcagttcaaaatctggaggaaaaaaatctgattggcttagcattggtcagttgtctacctgaggccaatcagctctgacccctgacagaagtcttatcctagacacatggccactgagatgtgagatgtccataaccccatggctgccagaggttgaagggtttccttctgtggacagagacatatttgttctctgaaaagaggagtcagaaataaattgcaacagatgtgtactacagcagtattgctaactttggaaacggagccagtattgaatactttatggttttgagaaattgtagatggcttcaaccaaggtcatgttagtatattgcaatggaaataggaccagactgttgtctttgttgactggcttcataaaaactactccttgcctcatgccagtgttgttgtttgtgatatttactcactaaatcagaagactcctcctcccaaacttgcttacatcaaggaggaaaaaaagtcctgatgataataactttattgtatttaaacattagcagattatgataatagctacatagtcattctttgctctgtgcatttgaccattgcagatgttttaatgctataaaagatcctgacttactcatctgtattatttctgtaactgggctatatatctgaaggaagtaatctgtgaaagtttcaagagggcatcagttggttacctttgcaaaaataggaaaaatatggaaaatgtaagtgttttaaaagaaaaacaaatttaaatctttgttcttgaaattcatcatttgcgcaaagtaattttttttgtaaggatgatttggtaaaggataaaagtttccggccgggcacggtggctcacacctgtaatcccagcactttgggaggccgaggcgggcagatcacgaggtcaggagatcaagaccatcctggctaacacggtgaaaccccgtctgtactaaaaatacaaaaaattagctgggcgtggtggtgggcacctgtagtcccagctattcaggaggctgaggcaggagaatggcgtgaacccggaaggcagagcttgcagt

SEQ ID NO: 1791 - DNA, 156 bp, Artificial Sequence
  Synthetic oligonucleotide
ataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaag

SEQ ID NO: 1792 - DNA, 650 bp, Artificial Sequence
  Synthetic oligonucleotide
gttaaattatacccttttaaatactctttttaaatttttctctttctttaaaaacccaaatatctaaaatgttaattttaagatacttgtatatgaagtcctaaattctggagctgattaatggaatgttcatcgaagttgagggtcatggctttactcatgcccagcagatgtgactgcctttcttaatggagatttatttgggttatcaaatgttattgagagtcagtgttctaggtgctgtggagacaagtgtgtaattgttctgttcttgagtaacttataatgtaaaaagggaaatggaagtatgtgtaaatcgtgtcagattacttttatgagagagatctgccagggcaacacttgcaagtgcaaaaaagtatgagagagcagaacccacagacgagacgtatctggtgtgccatgaactacagtgtcagtcaggggctgggctgtggccatggtgagcaaagcaggaaagataacgtgaaggagcctgtagggaccttccccaaccccgtgtaatacaaggtgctctttgttgtttgaccaaacaatgccaagcaaagactcaatgaaggtaagaaagagaggccgggcgcggtggctcacgcctgtaatcccagcactttgggaagccgaggtgggtggat

SEQ ID NO: 1793 - DNA, 144 bp, Artificial Sequence
  Synthetic oligonucleotide
ataaaaactcatctgcctcctccagccttgtgttacatcctcacagctcatccaaatctgggacaaattgatataattgacgaagaccccatttataagctttaccagcctccagttacccgctgcttaagagacattctccag

SEQ ID NO: 1794 - DNA, 179 bp, Artificial Sequence
  Synthetic oligonucleotide
ctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacag

SEQ ID NO: 1795 - DNA, 1010 bp, Artificial Sequence
  Synthetic oligonucleotide
agctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctgaactggtgtgatcgtgtctctgctgaatggtggtggggatagctggctccaccacacacacctgttttaattaggctgggtaatgtgcacggagagcaaagatcacagactaaggagcagtcagtcggatatttgctttgctggcaaagatttaaaccaagaattaattatctttggacactataaagattttgttcccttccttatagcaatataatcatgacaggccatggttaactacatcagatacacgtagcagccgtgaccaagacatggtgccctaataccaagtgttcttgggttaaaggcaggcggct

SEQ ID NO: 1796 - DNA, 119 bp, Artificial Sequence
  Synthetic oligonucleotide
agaaaaaggagttggaatacagaatgcccatcctttccaggagaaagaccactgcaggtcagaagagcaggtctcaggacagcaggggcagctgcctctctctctgaagcatggctcag

SEQ ID NO: 1797 - DNA, 19 bp, Artificial Sequence
  Synthetic oligonucleotide
gtgtggagaagggtttcag

SEQ ID NO: 1798 - DNA, 18 bp, Artificial Sequence
  Synthetic oligonucleotide
aacacttctgggaatccg

SEQ ID NO: 1799 - DNA, 67 bp, Artificial Sequence
  Synthetic oligonucleotide
tcattaacagctgaagagaagacgattacagaaaagcaccttgaattatgccctagacccaagcaag

SEQ ID NO: 1800 - DNA, 105 bp, Artificial Sequence
  Synthetic oligonucleotide
aaaccaccacatctaaaagcaccagtgggcttacagacataacatggagctccagtggaagtgatttgtcggatgaagataagacactttctcagttacagagag

SEQ ID NO: 1801 - DNA, 95 bp, Artificial Sequence
  Synthetic oligonucleotide
ccaagttctatagaaattttagagtattcatcagatagtgaaaaagaagatgatttggaaaatgtcctactcattgattcagaatcccctcacaa

SEQ ID NO: 1802 - DNA, 102 bp, Artificial Sequence
  Synthetic oligonucleotide
cactagagatgccgcggccccagctgcacacaaaaggaccctggtgtgggggacccttacaaaagaggacggaaacaacatagttttaaaccaataaacctt

SEQ ID NO: 1803 - DNA, 5 bp, Artificial Sequence
  Synthetic oligonucleotide
gacag

SEQ ID NO: 1804 - DNA, 83 bp, Artificial Sequence
  Synthetic oligonucleotide
cggggattttcagtttgattgacaccctgtggcccccagcgatacctctgaaaacacctggccgcgaccagccctgtgaagag

SEQ ID NO: 1805 - DNA, 60 bp, Artificial Sequence
  Synthetic oligonucleotide
atgaatgatcttggtacccgttgcagtttctatgccacggtgatttaccaaaaaccacag

SEQ ID NO: 1806 - DNA, 32 bp, Artificial Sequence
  Synthetic oligonucleotide
cctcttcttcaaggacgctctccgtgaccagg

SEQ ID NO: 1807 - DNA, 41 bp, Artificial Sequence
  Synthetic oligonucleotide
gtcggattgtttgtgctgaacgaactgtcctcttgcttcag

SEQ ID NO: 1808 - DNA, 112 bp, Artificial Sequence
  Synthetic oligonucleotide
aagccccttttgagtgtggtctctggtgcaagttcctgtgagctgcctggcccggtgatgctcgacagcctggactctgcaacacctgtcaactccatctgcagtgttcaag

SEQ ID NO: 1809 - DNA, 94 bp, Artificial Sequence
  Synthetic oligonucleotide
gcactgtggttggcgtggacgagagcactgctttctcatggcctgtgtgtgacatgtgtggcaacgggagattggaacagaggccggaagacag

SEQ ID NO: 1810 - DNA, 115 bp, Artificial Sequence
  Synthetic oligonucleotide
aggcgccttttcctgtggggactgctcccgggtggtcacatctcctgttctcaagaggcacctgcaggtcttcctggactgccgctcaagaccgcagtgcagagtgaaggtcaag

SEQ ID NO: 1811 - DNA, 54 bp, Artificial Sequence
  Synthetic oligonucleotide
ctgttgcagcgcagcatttcctccctgctgaggtttgccgccggtgaagatggg

SEQ ID NO: 1812 - DNA, 6389 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgaggtaaatatgtttttcagtcatagtgactttttaaaatgtcaattttccagatgagtatttagttttgttttcataatcaaattttagtaaatgtttgcgattgttttcttagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1813 - DNA, 6783 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagtaagtaacttactgtgcaccttatcattaaatgcctttgatataactgctttatcatattttggtttctggggaggttcagaggcacttgaaggttcttttatctttccccttccctagtcctctctttcttttgctcctgccaatgctatgcctcattcctgcctctttccttgtgcaaaaacccttagcctttctgaatcccatggttatatggctaaggaggttattaatagctgctctaaattatattcctacctattaataatacatatgcctaaaccagcccagagaaatacatatttttctctccttatttactccatttgtcattaggacacagtgatctgatagatttttaaggcctagactgttactgctgtactcatctccccaaacttagcatctagttagagttcattaaaagtgccttctaatgctttctatccatgaagctctaatatttttttctatgcgtatgataaatatgaactcttactatataggaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1814 - DNA, 6257 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1815 - DNA, 6667 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaaggtaggtactgttttctctgtggtgtacctctcgagttctttgtttgtttttttttaaattgtaataggtaataatacatgctggttatgttgtcagtgggtttcatggtgtctttctcaaattgtttgctattgtgtcgtgggaaacaagatgaaacactctgaatgtaaactaggacagcagtgtgctcagaagccagagatgagcagtcacaacacctaagtgttaataccccttaattataaggcttcttttacacacaggcataatctaagacccactccaggaattgtcttgggacagtttactttgattgggtcataacttttgaacctcatttttatttataatgtggcacctcttcctattattaagtattttattttgcagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1816 - DNA, 7687 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggagaaaatatactgcaggccgggcacagaggcttacgcctgtaatcccagcactttgggaggccaaggcaggaggattgcttgagcccacgagttggagatcagcctgggcaacaaaaaaaaaagtgagacctgtgtctacaaaaaataaaaaaataaaaatggagtatattgaaaatatatactgtaatatgaaaagttacacaaattaagaatatagcatagtactgagaatatgaaagcaatctagtcagtatttatgaaaataaactttggtggctgggtgcggtagctcatgcctgtaatcgcagcactttaggaggctgacgtgggcggatcacgaggtcagaagatcaagaccatcctggctaacacggtgaaaccccatctctactaaaaatacaaaaaaaaaaaaattagccatggtgtcaggtgcctgtagtcccagctacttgggaggatgaggcaggagaatggcatgaacccaagaggcaaagcttgcagtgagccgagactgcgccactgcactccagcctgggtgacagagcgagactccatctcaaaaaaaaaaaaaaaaaacgaaaagaaaagaaattgtggcatataagctttataggaaatagtgcaaccagtaaaacattttatgatgtatttcatatgctagtgtaatgaacgcagcaaagaacatgttacgtactcgacagacgatgataaaattatgagaaaccttttgaaggaatacaacagagcaaaacatctgttttttaaaattatcattgtgtattatgaatattaaacaaatgtttgtgatttatatgtgaaacaatgtctttttaccgcttttttgttttcccaaaagttgagttaccattccaatttgaaatggactgtgtacacgcttcatttagtacttttgtaaactgtgtttgtgatctgacagcagcctgtgaaattcataagaatcacataggatgtaagtctccatgatgtatgccaattacagaaattaggttggtctgtgtctttgttactaacaaaaatagctatagcagtggccttcagagatgtagagtctggaaaaacttgatcttaatgtcaggttctggcactgcttttacagttatagccctgatgagagctatcagtagggaaaataatttatggagaaatttaattttgctaaaagagataaaagtttatgctcataaccctaatgtagtttttatccattatgaggccacaaactctttgagaatctgctgaaatctctattaagaaactgccaaagagcatacacaaaatttgcatgcaatttcagggaaggtcttcaccccagttcccacactaccccctatcctccattattccctcagacttagaatgtcagtcctaatagaaattattatatctacaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1817 - DNA, 7699 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggagaaaatatactgcaggccgggcacagaggcttacgcctgtaatcccagcactttgggaggccaaggcaggaggattgcttgagcccacgagttggagatcagcctgggcaacaaaaaaaaaagtgagacctgtgtctacaaaaaataaaaaaataaaaatggagtatattgaaaatatatactgtaatatgaaaagttacacaaattaagaatatagcatagtactgagaatatgaaagcaatctagtcagtatttatgaaaataaactttggtggctgggtgcggtagctcatgcctgtaatcgcagcactttaggaggctgacgtgggcggatcacgaggtcagaagatcaagaccatcctggctaacacggtgaaaccccatctctactaaaaatacaaaaaaaaaaaaattagccatggtgtcaggtgcctgtagtcccagctacttgggaggatgaggcaggagaatggcatgaacccaagaggcaaagcttgcagtgagccgagactgcgccactgcactccagcctgggtgacagagcgagactccatctcaaaaaaaaaaaaaaaaaacgaaaagaaaagaaattgtggcatataagctttataggaaatagtgcaaccagtaaaacattttatgatgtatttcatatgctagtgtaatgaacgcagcaaagaacatgttacgtactcgacagacgatgataaaattatgagaaaccttttgaaggaatacaacagagcaaaacatctgttttttaaaattatcattgtgtattatgaatattaaacaaatgtttgtgatttatatgtgaaacaatgtctttttaccgcttttttgttttcccaaaagttgagttaccattccaatttgaaatggactgtgtacacgcttcatttagtacttttgtaaactgtgtttgtgatctgacagcagcctgtgaaattcataagaatcacataggatgtaagtctccatgatgtatgccaattacagaaattaggttggtctgtgtctttgttactaacaaaaatagctatagcagtggccttcagagatgtagagtctggaaaaacttgatcttaatgtcaggttctggcactgcttttacagttatagccctgatgagagctatcagtagggaaaataatttatggagaaatttaattttgctaaaagagataaaagtttatgctcataaccctaatgtagtttttatccattatgaggccacaaactctttgagaatctgctgaaatctctattaagaaactgccaaagagcatacacaaaatttgcatgcaatttcagggaaggtcttcaccccagttcccacactaccccctatcctccattattccctcagacttagaatgtcagtcctaatagaaattattatatctacaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcaggtaacattgctgagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1818 - DNA, 1566 bp, Homo sapiens
ggtgcgatcttggctcactgcagcctctgcttccctggtcaaatgattctcatgcctcagcttctgggtatctgtgacttcacatgccatcacacccagctaatttttgtatttttagcagagacagggtttcgccacgttggccaagctgttcttgaactcctgacctcaggtcatccacccgccctggtctctcagtgtgctgggattataggcatgaaccaccatgcctggccaccagctgatttttaaaaattatttttggagagacaggttctcactttattgccctggctggtctcaaattcctggcctcaagtgatcctcctaccttggcctcccaaagtgctgggattacaggtatgagccactgtgcccagctgacaaattcttaaatacagaattatttttagtttagcctcaaaatcaagtatttgatgtgtttacatgtagattcattttaaatgcagaaattcacatattgaaaacaacacaattgaaaactaattttatctcactgtaacaagtgcattagagacatatatatatttgcacaaatgttgctattctctttgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1819 - DNA, 2077 bp, Homo sapiens
ggtgcgatcttggctcactgcagcctctgcttccctggtcaaatgattctcatgcctcagcttctgggtatctgtgacttcacatgccatcacacccagctaatttttgtatttttagcagagacagggtttcgccacgttggccaagctgttcttgaactcctgacctcaggtcatccacccgccctggtctctcagtgtgctgggattataggcatgaaccaccatgcctggccaccagctgatttttaaaaattatttttggagagacaggttctcactttattgccctggctggtctcaaattcctggcctcaagtgatcctcctaccttggcctcccaaagtgctgggattacaggtatgagccactgtgcccagctgacaaattcttaaatacagaattatttttagtttagcctcaaaatcaagtatttgatgtgtttacatgtagattcattttaaatgcagaaattcacatattgaaaacaacacaattgaaaactaattttatctcactgtaacaagtgcattagagacatatatatatttgcacaaatgttgctattctctttgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaaggtaagtcagcaaagttctgaatttacattggtttggtgactgagaactagatatttattgttttttttctttttgctgacattcttagatgtcagtgtttagataaagttggatggcggggattgtttgtttttaaacatggcttttgctacggccattggaaatgagaattttgctgtgcctccttgctttaggtttaaagcagagaaaatgtgtgactgcttttggacctttgtagatgagtggtgtcagcctgggaatagttagataaaggaaaatacatcttattcttggttgcctcctgggtggggctgggacattttgtgtggccctgaggactctgggttctaaaagttgtgagaacttgatctggattcttacacccattctgttaaagagggagtacccagaagcctttctactggaataggaagaataaaaatttcatttattaggcttttagagttggatgtcttgttacctaattgaaattttttcctccctgatacagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 1820 - DNA, 5975 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggtaaaatttaagttatagaaaacggaaattcagtcaatttaaagaaaccatcatggttccctttttaataagtatttgcggccaggtgcaattgtttatatttataacctcaactctttgagagacgaagtcagtgagatcacttgatgccaggagtttgagaccagcctggacaacgtagcaagactgtctctacaaaaagtaccaaaattagctggacatgatggtgtgcacctgtgatcccagctattcaggaggtcgaggtcggaggatcgcttaagcctggaggttgagcctgcagtgagctgtgattgtaccactgcattcatcctgagcagcagagtgagaccctgtctcaaaaaaattaaataaaaataactttaattttaacatagccctatgtgagtaattttgataccctaatcatgattccttataatacaaatggaagaaaaattgggcatgttttcgttctgtcttctttgcagttgggcaaataatactcctgaacccaagttttcttaaccatgagaaattggggatgataattgtaattgtcccactagtcctactgatttttaaggaactcatgagaatgtgcatgatggcagtttcaaagggattaaaaatctacacataggcgctgctatccagtagacttaatacaggtttgctgtcctttttttgtttttctttggtagaaaaaggtaacttttgtggtgaggttacattaatggtttgtacaaaaagataatgtattatcccatacagccaaatgtaagagcatgttggcagtaaatatggcatgagatactactttttaagttggcattaaggaagaaaatgtaa

SEQ ID NO: 1821 - DNA, 3157 bp, Homo sapiens
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcgggtcagtattttcacctaaaagtctgcactaattgttttaaagtcgtataataacctcgtaatttgggtattattcagcatatagaagaagttttcctaaaaggaaaaatagtagatttaaaagtatgtaaaagttaaaaacatcatggtagaaatcaaatggatcctagcaaaaaatatatttttcttatacagaatcttctgcctgtttccatgacagtctctaaactctcaatgggaatttggacaatagcattgagactaccttgtaagaacttgaaggaatttaaaaataggaggaattatctatgggcatgaatttaaagcattacactttatgtagatctg

SEQ ID NO: 1822 - DNA, 268 bp, Artificial Sequence
  Synthetic oligonucleotide
ggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccac

SEQ ID NO: 1823 - DNA, 141 bp, Artificial Sequence
  Synthetic oligonucleotide
atatattcgactttatgggagaaaatttagcaaagaagatcatgttctttttattaagttattgtatgagctggtatcaattccaaaactggaaatcagcatgatgcagggatttgcccgccttttgatcaacttgttaaa

SEQ ID NO: 1824 - DNA, 150 bp, Artificial Sequence
  Synthetic oligonucleotide
atattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaa

SEQ ID NO: 1825 - DNA, 123 bp, Artificial Sequence
  Synthetic oligonucleotide
atatttacaagaattctgagaagcttgaacctcccagtgggaagcagtcaagtgttagtcccaagatttttaacaaatgcttatgatataggacatgctgtaatatggatcaccgccatgatg

SEQ ID NO: 1826 - DNA, 266 bp, Artificial Sequence
  Synthetic oligonucleotide
aacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaag

SEQ ID NO: 1827 - DNA, 187 bp, Artificial Sequence
  Synthetic oligonucleotide
aacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatg

SEQ ID NO: 1828 - DNA, 151 bp, Artificial Sequence
  Synthetic oligonucleotide
atgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatg

SEQ ID NO: 1829 - DNA, 216 bp, Artificial Sequence
  Synthetic oligonucleotide
attactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaag

SEQ ID NO: 1830 - DNA, 158 bp, Artificial Sequence
  Synthetic oligonucleotide
gactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctag

SEQ ID NO: 1831 - DNA, 347 bp, Artificial Sequence
  Synthetic oligonucleotide
gtcagtattttcacctaaaagtctgcactaattgttttaaagtcgtataataacctcgtaatttgggtattattcagcatatagaagaagttttcctaaaaggaaaaatagtagatttaaaagtatgtaaaagttaaaaacatcatggtagaaatcaaatggatcctagcaaaaaatatatttttcttatacagaatcttctgcctgtttccatgacagtctctaaactctcaatgggaatttggacaatagcattgagactaccttgtaagaacttgaaggaatttaaaaataggaggaattatctatgggcatgaatttaaagcattacactttatgtagatctg

SEQ ID NO: 1832 - DNA, 132 bp, Artificial Sequence
  Synthetic oligonucleotide
gtgagaaataaggctcagcaaacattttttgctgccttgggagcatataacttctgttgcagagatatcattcccttggttttggagttcttaaggcctgatagacaaggtgttacacagcaacaattcaag

SEQ ID NO: 1833 - DNA, 210 bp, Artificial Sequence
  Synthetic oligonucleotide
ggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcaca

SEQ ID NO: 1834 - DNA, 137 bp, Artificial Sequence
  Synthetic oligonucleotide
attccaaagtcatgtgttgaaatagcggaattacttcaacagtcaaaaaacccctctatcaaccagatattgcttagcccagaaaaaattaaggaaggaattaaacgccaacaggaaaagaatgccgatgccctaag

SEQ ID NO: 1835 - DNA, 130 bp, Artificial Sequence
  Synthetic oligonucleotide
gccctggaaatttgaacatataggcattgggcttctgtctctactgctgagagatgaccgagtgttgcctcttcgtgccatacggttttttgttgagaatctcaaccatgatgcaattgtagttcgaaag

SEQ ID NO: 1836 - DNA, 154 bp, Artificial Sequence
  Synthetic oligonucleotide
gtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaa

SEQ ID NO: 1837 - DNA, 506 bp, Artificial Sequence
  Synthetic oligonucleotide
gtaagtaacttactgtgcaccttatcattaaatgcctttgatataactgctttatcatattttggtttctggggaggttcagaggcacttgaaggttcttttatctttccccttccctagtcctctctttcttttgctcctgccaatgctatgcctcattcctgcctctttccttgtgcaaaaacccttagcctttctgaatcccatggttatatggctaaggaggttattaatagctgctctaaattatattcctacctattaataatacatatgcctaaaccagcccagagaaatacatatttttctctccttatttactccatttgtcattaggacacagtgatctgatagatttttaaggcctagactgttactgctgtactcatctccccaaacttagcatctagttagagttcattaaaagtgccttctaatgctttctatccatgaagctctaatatttttttctatgcgtatgataaatatgaactcttactatatag

SEQ ID NO: 1838 - DNA, 126 bp, Artificial Sequence
  Synthetic oligonucleotide
gcagaacagattatatttgatcatttttctgatcctaaatttgttgagcagttaattacttttctatcattagaagacagaaaaggaaaagataagtttaatccacgacgtttttgtctctttaag

SEQ ID NO: 1839 - DNA, 153 bp, Artificial Sequence
  Synthetic oligonucleotide
ggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaag

SEQ ID NO: 1840 - DNA, 390 bp, Artificial Sequence
  Synthetic oligonucleotide
gtaggtactgttttctctgtggtgtacctctcgagttctttgtttgtttttttttaaattgtaataggtaataatacatgctggttatgttgtcagtgggtttcatggtgtctttctcaaattgtttgctattgtgtcgtgggaaacaagatgaaacactctgaatgtaaactaggacagcagtgtgctcagaagccagagatgagcagtcacaacacctaagtgttaataccccttaattataaggcttcttttacacacaggcataatctaagacccactccaggaattgtcttgggacagtttactttgattgggtcataacttttgaacctcatttttatttataatgtggcacctcttcctattattaagtattttattttgcag

SEQ ID NO: 1841 - DNA, 209 bp, Artificial Sequence
  Synthetic oligonucleotide
tgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaacca

SEQ ID NO: 1842 - DNA, 120 bp, Artificial Sequence
  Synthetic oligonucleotide
attgccccagtggaaaatgacaatagctacgatgaactgaaaagagatgcaaagttatgtttatcattaatgtctcaggggttgctttaccctcatcaagtgcctttggtacttcaggtg

SEQ ID NO: 1843 - DNA, 849 bp, Artificial Sequence
  Synthetic oligonucleotide
gtaaaatttaagttatagaaaacggaaattcagtcaatttaaagaaaccatcatggttccctttttaataagtatttgcggccaggtgcaattgtttatatttataacctcaactctttgagagacgaagtcagtgagatcacttgatgccaggagtttgagaccagcctggacaacgtagcaagactgtctctacaaaaagtaccaaaattagctggacatgatggtgtgcacctgtgatcccagctattcaggaggtcgaggtcggaggatcgcttaagcctggaggttgagcctgcagtgagctgtgattgtaccactgcattcatcctgagcagcagagtgagaccctgtctcaaaaaaattaaataaaaataactttaattttaacatagccctatgtgagtaattttgataccctaatcatgattccttataatacaaatggaagaaaaattgggcatgttttcgttctgtcttctttgcagttgggcaaataatactcctgaacccaagttttcttaaccatgagaaattggggatgataattgtaattgtcccactagtcctactgatttttaaggaactcatgagaatgtgcatgatggcagtttcaaagggattaaaaatctacacataggcgctgctatccagtagacttaatacaggtttgctgtcctttttttgtttttctttggtagaaaaaggtaacttttgtggtgaggttacattaatggtttgtacaaaaagataatgtattatcccatacagccaaatgtaagagcatgttggcagtaaatatggcatgagatactactttttaagttggcattaaggaagaaaatgtaa

SEQ ID NO: 1844 - DNA, 1410 bp, Artificial Sequence
  Synthetic oligonucleotide
aaaatatactgcaggccgggcacagaggcttacgcctgtaatcccagcactttgggaggccaaggcaggaggattgcttgagcccacgagttggagatcagcctgggcaacaaaaaaaaaagtgagacctgtgtctacaaaaaataaaaaaataaaaatggagtatattgaaaatatatactgtaatatgaaaagttacacaaattaagaatatagcatagtactgagaatatgaaagcaatctagtcagtatttatgaaaataaactttggtggctgggtgcggtagctcatgcctgtaatcgcagcactttaggaggctgacgtgggcggatcacgaggtcagaagatcaagaccatcctggctaacacggtgaaaccccatctctactaaaaatacaaaaaaaaaaaaattagccatggtgtcaggtgcctgtagtcccagctacttgggaggatgaggcaggagaatggcatgaacccaagaggcaaagcttgcagtgagccgagactgcgccactgcactccagcctgggtgacagagcgagactccatctcaaaaaaaaaaaaaaaaaacgaaaagaaaagaaattgtggcatataagctttataggaaatagtgcaaccagtaaaacattttatgatgtatttcatatgctagtgtaatgaacgcagcaaagaacatgttacgtactcgacagacgatgataaaattatgagaaaccttttgaaggaatacaacagagcaaaacatctgttttttaaaattatcattgtgtattatgaatattaaacaaatgtttgtgatttatatgtgaaacaatgtctttttaccgcttttttgttttcccaaaagttgagttaccattccaatttgaaatggactgtgtacacgcttcatttagtacttttgtaaactgtgtttgtgatctgacagcagcctgtgaaattcataagaatcacataggatgtaagtctccatgatgtatgccaattacagaaattaggttggtctgtgtctttgttactaacaaaaatagctatagcagtggccttcagagatgtagagtctggaaaaacttgatcttaatgtcaggttctggcactgcttttacagttatagccctgatgagagctatcagtagggaaaataatttatggagaaatttaattttgctaaaagagataaaagtttatgctcataaccctaatgtagtttttatccattatgaggccacaaactctttgagaatctgctgaaatctctattaagaaactgccaaagagcatacacaaaatttgcatgcaatttcagggaaggtcttcaccccagttcccacactaccccctatcctccattattccctcagacttagaatgtcagtcctaatagaaattattatatctacag

SEQ ID NO: 1845 - DNA, 163 bp, Artificial Sequence
  Synthetic oligonucleotide
gttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcag

SEQ ID NO: 1846 - DNA, 578 bp, Artificial Sequence
  Synthetic oligonucleotide
ggtgcgatcttggctcactgcagcctctgcttccctggtcaaatgattctcatgcctcagcttctgggtatctgtgacttcacatgccatcacacccagctaatttttgtatttttagcagagacagggtttcgccacgttggccaagctgttcttgaactcctgacctcaggtcatccacccgccctggtctctcagtgtgctgggattataggcatgaaccaccatgcctggccaccagctgatttttaaaaattatttttggagagacaggttctcactttattgccctggctggtctcaaattcctggcctcaagtgatcctcctaccttggcctcccaaagtgctgggattacaggtatgagccactgtgcccagctgacaaattcttaaatacagaattatttttagtttagcctcaaaatcaagtatttgatgtgtttacatgtagattcattttaaatgcagaaattcacatattgaaaacaacacaattgaaaactaattttatctcactgtaacaagtgcattagagacatatatatatttgcacaaatgttgctattctctttgcag

SEQ ID NO: 1847 - DNA, 134 bp, Artificial Sequence
  Synthetic oligonucleotide
agttggtcaaacgccatgctggggtgctaggacttggtgcatgtgttctttctagtccttacgatgttcccacctggatgccccagctcctcatgaatctcagtgcacatctaaatgatcctcagcctattgag

SEQ ID NO: 1848 - DNA, 139 bp, Artificial Sequence
  Synthetic oligonucleotide
atgactgtaaaaaaaaccttatccaatttccgaaggactcaccatgacaactggcaggaacataaacagcaattcactgatgaccaactgcttgttctcaccgatcttcttgtgtcaccatgctattatgcatagaaag

SEQ ID NO: 1849 - DNA, 511 bp, Artificial Sequence
  Synthetic oligonucleotide
gtaagtcagcaaagttctgaatttacattggtttggtgactgagaactagatatttattgttttttttctttttgctgacattcttagatgtcagtgtttagataaagttggatggcggggattgtttgtttttaaacatggcttttgctacggccattggaaatgagaattttgctgtgcctccttgctttaggtttaaagcagagaaaatgtgtgactgcttttggacctttgtagatgagtggtgtcagcctgggaatagttagataaaggaaaatacatcttattcttggttgcctcctgggtggggctgggacattttgtgtggccctgaggactctgggttctaaaagttgtgagaacttgatctggattcttacacccattctgttaaagagggagtacccagaagcctttctactggaataggaagaataaaaatttcatttattaggcttttagagttggatgtcttgttacctaattgaaattttttcctccctgatacag

SEQ ID NO: 1850 - DNA, 370 bp, Artificial Sequence
  Synthetic oligonucleotide
gtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttag

SEQ ID NO: 1851 - DNA, 342 bp, Artificial Sequence
  Synthetic oligonucleotide
gtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctg

SEQ ID NO: 1852 - DNA, 117 bp, Artificial Sequence
  Synthetic oligonucleotide
gaaaaaggaacttctttcaagagctgatttggagttaccctggagaccactttatgacatggtagaaagaatattatattccaagacagagcacctaggattaaattggtttcctaa

SEQ ID NO: 1853 - DNA, 45 bp, Artificial Sequence
  Synthetic oligonucleotide
ttctgtagaaaatattctcaaaacactcgtgaaaagctgccgacc

SEQ ID NO: 1854 - DNA, 64 bp, Artificial Sequence
  Synthetic oligonucleotide
actttggtttgatgaattaattggcctttgggtttcagtgcaaaatctcccacaatgggagggg

SEQ ID NO: 1855 - DNA, 75 bp, Artificial Sequence
  Synthetic oligonucleotide
caactagtaaatctctttgctcgattggctacagataatatagggtacatagattgggatccatatgtaccaaag

SEQ ID NO: 1856 - DNA, 93 bp, Artificial Sequence
  Synthetic oligonucleotide
ggtggaccaagtaagctagtgcaaaaacacttagctggtttgtttaacagcatcacatctttttaccatccttcaaataatgggcgctggctg

SEQ ID NO: 1857 - DNA, 90 bp, Artificial Sequence
  Synthetic oligonucleotide
atcacattccagttcatagcaacattttctactctggtgcctttagtagattgttcatctgtactacaagaaagaaatgacctcacagaa

SEQ ID NO: 1858 - DNA, 65 bp, Artificial Sequence
  Synthetic oligonucleotide
gtggaacgagaactttgttcagccacagctgaatttgaggatttcgtcttacagtttatggacag

SEQ ID NO: 1859 - DNA, 99 bp, Artificial Sequence
  Synthetic oligonucleotide
gtggcccttcagaaggtttttaatttttctacttcacatatatttgaaacaagagtagcaggtcgcatggtggcagacatgtgccgcgctgctgtaaag

SEQ ID NO: 1860 - DNA, 70 bp, Artificial Sequence
  Synthetic oligonucleotide
tgctgcccagaagaatctttgaagctctttgttccccactgctgcagtgttataactcagcttacaatga

SEQ ID NO: 1861 - DNA, 68 bp, Artificial Sequence
  Synthetic oligonucleotide
atgatgatgtattaaatgatgaagagctagacaaggaattactatggaatcttcaacttttgtctgag

SEQ ID NO: 1862 - DNA, 96 bp, Artificial Sequence
  Synthetic oligonucleotide
agatgatattctacagagtctgactatagtgcacaactgtttaattggctctggaaacctcctacctccgttgaaaggagagccagttactaactt

SEQ ID NO: 1863 - DNA, 56 bp, Artificial Sequence
  Synthetic oligonucleotide
agtaccaagtatggtgtccttggaagagacaaagttgtatactggacttgaatatg

SEQ ID NO: 1864 - DNA, 57 bp, Artificial Sequence
  Synthetic oligonucleotide
atctgtctcgagagaaccaccgagaagtaattgctacagttataaggaaacttctta

SEQ ID NO: 1865 - DNA, 56 bp, Artificial Sequence
  Synthetic oligonucleotide
accacatacttgataattcagaagatgatactaagtcattgtttcttattataaag

SEQ ID NO: 1866 - DNA, 99 bp, Artificial Sequence
  Synthetic oligonucleotide
attattggagaccttttacaattccaaggatctcacaagcatgaatttgactcccgatggaaaagcttcaacttagtaaagaaatcaatggaaaatcgg

SEQ ID NO: 1867 - DNA, 63 bp, Artificial Sequence
  Synthetic oligonucleotide
ctccatgggaaaaaacaacatatcagagcactgttgattgatagagtaatgttacagcatgag

SEQ ID NO: 1868 - DNA, 112 bp, Artificial Sequence
  Synthetic oligonucleotide
gtaaatatgtttttcagtcatagtgactttttaaaatgtcaattttccagatgagtatttagttttgttttcataatcaaattttagtaaatgtttgcgattgttttcttag

SEQ ID NO: 1869 - DNA, 96 bp, Artificial Sequence
  Synthetic oligonucleotide
ctacggacactaactgttgagggttgtgaatacaaaaagatacatcaagatatgatcagagatcttcttcgtttatctacaagttcatacagtcag

SEQ ID NO: 1870 - DNA, 54 bp, Artificial Sequence
  Synthetic oligonucleotide
gaactatgaaaatttggtagacaccttgctagatggtgtggagcaaagaaacct

SEQ ID NO: 1871 - DNA, 82 bp, Artificial Sequence
  Synthetic oligonucleotide
atggctatctcagctgttgctggtatccttaaacagctaaaaagaacccacaaaaagctgaccattaacccctgtgaaatca

SEQ ID NO: 1872 - DNA, 70 bp, Artificial Sequence
  Synthetic oligonucleotide
gaatatggttgtttatgctggtgtggaagagcagcctaagcttggcagaagcagggaggatatgacagag

SEQ ID NO: 1873 - DNA, 105 bp, Artificial Sequence
  Synthetic oligonucleotide
gtggagaagctttgggagcttctgtgccctctgcttagaacagcactgtccaatattaccgtagaaacttataatgactggggagcttgtatagcaacatcctgt

SEQ ID NO: 1874 - DNA, 92 bp, Artificial Sequence
  Synthetic oligonucleotide
gaaagcagagatccccggaaacttcactggctttttgaactgctgttggaatcaccattgagtggtgaaggaggatcctttgtagatgcatg

SEQ ID NO: 1875 - DNA, 20 bp, Artificial Sequence
  Synthetic oligonucleotide
tcgactttatgtactacaag

SEQ ID NO: 1876 - DNA, 112 bp, Artificial Sequence
  Synthetic oligonucleotide
gtggccttgcccagcaagaatggagagtgcctgaactattgcacagactactgaagtacttggaacccaaactcacccaggtttacaaaaatgtcagagaaagaataggaag

SEQ ID NO: 1877 - DNA, 86 bp, Artificial Sequence
  Synthetic oligonucleotide
tattgaaatggctgatggcaagtgcaggaagatccttttctacagcagttacagaacaacttcagcttctacctttgtttttcaag

SEQ ID NO: 1878 - DNA, 9 bp, Artificial Sequence
  Synthetic oligonucleotide
ctaaaacaa

SEQ ID NO: 1879 - DNA, 44 bp, Artificial Sequence
  Synthetic oligonucleotide
acagcaagaagcagttcttggcatgcacgatacacagtactgac

SEQ ID NO: 1880 - DNA, 112 bp, Artificial Sequence
  Synthetic oligonucleotide
ctacctccagaccatggtattttataacctctttattttcctaaacaatgaagatgcagttaaagatatcaggtggctggttataagtcttttggaggacgaacaactggag

SEQ ID NO: 1881 - DNA, 12 bp, Artificial Sequence
  Synthetic oligonucleotide
gtaacattgctg

SEQ ID NO: 1882 - DNA, 51 bp, Artificial Sequence
  Synthetic oligonucleotide
atgactagtcctcacttcaggctcttttcatcaaaaattccacaccctcag

SEQ ID NO: 1883 - DNA, 1892 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctcctgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcagcgggcgtggatgggtcgccactccagggcagcgacatccaggttcagtacgtgcagctggcgccagtgagtgaccacacggccggggcacaggtgagtctggggccccgcgccgggacactgaagtgatggcatggccgcctgccgctgccaccgggcacacgtggccccggggctttctcgtgactcttcctgtgcagagggcacgtgattggacacagatgcccatctgagggttctacgtctcacactcaccgtgaacgtgaaggtgagaaggtagatcctgccccagttccaaattccaactgattcttgagactgtcttgtggaaatgtttgtaaattcaggggcagaagtgaagctctgccctgtcctcc

SEQ ID NO: 1884 - DNA, 658 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctcctgtgctctggatgatgtcggaacacgacctggccgatgtggttcagattgcagtggaagacctgagccctgaccacccaggtacagagctgtgggacagtagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgggcgctaccgttttggaatgataccaacacttacgtggttacgaacgttagatctgtcccataggaatgagttgggatggagtgactgaaaatgtcaagccagttctcatgcaagtgtgcc

SEQ ID NO: 1885 - DNA, 139 bp, Artificial Sequence
  Synthetic oligonucleotide
gtgaccaaaagccagccccactgtgagttgaactctttcgtgttgaccggccactctcctgtgctctggatgatgtcggaacacgacctggccgatgtggttcagattgcagtggaagacctgagccctgaccacccag

SEQ ID NO: 1886 - DNA, 141 bp, Artificial Sequence
  Synthetic oligonucleotide
acaatctgcttgcggttggatagcattgaagccaaattgcaagccctggaggctacttgtaaatccttagaagaaaagctggatctggtcacgaacaagcagcacagccccatccaggttcccatggtggccggctcccct

SEQ ID NO: 1887 - DNA, 121 bp, Artificial Sequence
  Synthetic oligonucleotide
ggcgctaccgttttggaatgataccaacacttacgtggttacgaacgttagatctgtcccataggaatgagttgggatggagtgactgaaaatgtcaagccagttctcatgcaagtgtgcc

SEQ ID NO: 1888 - DNA, 135 bp, Artificial Sequence
  Synthetic oligonucleotide
cgctgtgcctgggcgtcggcagaacaccattgtggtgaaggtgccgggccaagaagacagccaccacgaggacggggagagcggctcggaggccagcgactctgtgtccagctgtgggcaggcgggcagtcagag

SEQ ID NO: 1889 - DNA, 240 bp, Artificial Sequence
  Synthetic oligonucleotide
aggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggt

SEQ ID NO: 1890 - DNA, 138 bp, Artificial Sequence
  Synthetic oligonucleotide
aatccgactggtaccgaatcaagcagagcatcgactccaagtgccgcacggcgtggcggcgcaagcagcggggccagagcctggcggtcaagagcttctcgcggagaacgcccaactcgtcctcctactgcccttcag

SEQ ID NO: 1891 - DNA, 144 bp, Artificial Sequence
  Synthetic oligonucleotide
gtgctgcagggtgcacagctgatcgccgtggcctcctcggaccccgcggcagcgggcgtggatgggtcgccactccagggcagcgacatccaggttcagtacgtgcagctggcgccagtgagtgaccacacggccggggcacag

SEQ ID NO: 1892 - DNA, 175 bp, Artificial Sequence
  Synthetic oligonucleotide
gtgagtctggggccccgcgccgggacactgaagtgatggcatggccgcctgccgctgccaccgggcacacgtggccccggggctttctcgtgactcttcctgtgcagagggcacgtgattggacacagatgcccatctgagggttctacgtctcacactcaccgtgaacgtgaag

SEQ ID NO: 1893 - DNA, 84 bp, Artificial Sequence
  Synthetic oligonucleotide
gcagagcggcggcttctctcgcgaggacggacgccattatcgcatctccccgacaaacaccacgagaattccgcagcccacacg

SEQ ID NO: 1894 - DNA, 18 bp, Artificial Sequence
  Synthetic oligonucleotide
gtacagagctgtgggaca

SEQ ID NO: 1895 - DNA, 4 bp, Artificial Sequence
  Synthetic oligonucleotide
gtag

SEQ ID NO: 1896 - DNA, 39 bp, Artificial Sequence
  Synthetic oligonucleotide
ttgttttggagaatcatgtagtgacagatgaagacgaac

SEQ ID NO: 1897 - DNA, 53 bp, Artificial Sequence
  Synthetic oligonucleotide
ctgctttgaaacgccagcgactagaaatcaattgccaggatccatctataaag

SEQ ID NO: 1898 - DNA, 24 bp, Artificial Sequence
  Synthetic oligonucleotide
tcattcctgtattccatcaaccag

SEQ ID NO: 1899 - DNA, 23 bp, Artificial Sequence
  Synthetic oligonucleotide
ctcggggcaacccagacgtgcaa

SEQ ID NO: 1900 - DNA, 12 bp, Artificial Sequence
  Synthetic oligonucleotide
caaagtgcgatg

SEQ ID NO: 1901 - DNA, 117 bp, Artificial Sequence
  Synthetic oligonucleotide
cgtcgtcccccagactacagtaatactcaacaatgatcggcagaacgccattgtagccaagatggaagaccccttgagcaacagggcaccggattccctggaaaatgtcattagcaa

SEQ ID NO: 1902 - DNA, 41 bp, Artificial Sequence
  Synthetic oligonucleotide
catcgggagcaacgtcacgctcatcaccctgaactcggaag

SEQ ID NO: 1903 - DNA, 30 bp, Artificial Sequence
  Synthetic oligonucleotide
gtcaccttttctataaatttggcatcacag

SEQ ID NO: 1904 - DNA, 110 bp, Artificial Sequence
  Synthetic oligonucleotide
agccgatgatgagcaccccacctcctgccagcgagctcccgcagccacagccgcagccgcaggccctgcactacgcgctggccaacgcacagcaggtgcagatccaccag

SEQ ID NO: 1905 - DNA, 27 bp, Artificial Sequence
  Synthetic oligonucleotide
atcggagaagacggacaggtgcaagta

SEQ ID NO: 1906 - DNA, 9 bp, Artificial Sequence
  Synthetic oligonucleotide
atcccacag

SEQ ID NO: 1907 - DNA, 63 bp, Artificial Sequence
  Synthetic oligonucleotide
ggacacctccacatcgcccaggtgccgcagggggagcaagtccagatcacgcaggacagcgag

SEQ ID NO: 1908 - DNA, 39 bp, Artificial Sequence
  Synthetic oligonucleotide
ggcaacctccagatccatcacgtggggcaggacggtcag

SEQ ID NO: 1909 - DNA, 109 bp, Artificial Sequence
  Synthetic oligonucleotide
gtgagaaggtagatcctgccccagttccaaattccaactgattcttgagactgtcttgtggaaatgtttgtaaattcaggggcagaagtgaagctctgccctgtcctcc

SEQ ID NO: 1910 - DNA, 3800 bp, Homo sapiens
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagggtcttgctctgtcacccaggctggagtgtgcacttcagtggcgtgatcacagctcactgcagcctccatctcctgggctcaagtgatcttcctgccttagcctctcgagttgctgaaactacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctgattgtgtta

SEQ ID NO: 1911 - DNA, 3008 bp, Homo sapiens
tgctagaactttgcttgtacttgccacatgagttggaagtgtactggtagggagctttagtttgcattttaaatgcgtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctgattgtgtta

SEQ ID NO: 1912 - DNA, 649 bp, Homo sapiens
gcactttgcgaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcagggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccaggtaggggatggggagagcagccaaaatgttaattgcttggttggttgattgtacagg

SEQ ID NO: 1913 - DNA, 230 bp, Artificial Sequence
  Synthetic oligonucleotide
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcag

SEQ ID NO: 1914 - DNA, 274 bp, Artificial Sequence
  Synthetic oligonucleotide
gtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacg

SEQ ID NO: 1915 - DNA, 125 bp, Artificial Sequence
  Synthetic oligonucleotide
ggtcttgctctgtcacccaggctggagtgtgcacttcagtggcgtgatcacagctcactgcagcctccatctcctgggctcaagtgatcttcctgccttagcctctcgagttgctgaaactacag

SEQ ID NO: 1916 - DNA, 176 bp, Artificial Sequence
  Synthetic oligonucleotide
aaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttg

SEQ ID NO: 1917 - DNA, 137 bp, Artificial Sequence
  Synthetic oligonucleotide
tgctagaactttgcttgtacttgccacatgagttggaagtgtactggtagggagctttagtttgcattttaaatgcgtgatagtgatttgttttgcttccttgctgatcagacaatgatgatcttcccttttcacag

SEQ ID NO: 1918 - DNA, 123 bp, Artificial Sequence
  Synthetic oligonucleotide
aggagaaggccaatttggagaataagttactggggaagaatggaactggagggctttttcagggcaaaactcctttgagaaaggctaatcttcagcaagctattgtcacacctttgaaaccag

SEQ ID NO: 1919 - DNA, 129 bp, Artificial Sequence
  Synthetic oligonucleotide
aagatctcttaggctttctgctcagaaggatttggaacagaaagaaaagcatcatgtaaaaatgaaagccaagagatgtgccactcctgtaatcatcgatgaaattctaccctctaagaaaatgaaagt

SEQ ID NO: 1920 - DNA, 122 bp, Artificial Sequence
  Synthetic oligonucleotide
gcagaagtttctaaaaagtactgaggagcaagagctggagaagagtatgaaaatgcagcaagaggtggtggagatgcggaaaaagaatgaagaattcaagaaacttgctctggctggaatag

SEQ ID NO: 1921 - DNA, 152 bp, Artificial Sequence
  Synthetic oligonucleotide
ggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcct

SEQ ID NO: 1922 - DNA, 172 bp, Artificial Sequence
  Synthetic oligonucleotide
gcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatatta

SEQ ID NO: 1923 - DNA, 142 bp, Artificial Sequence
  Synthetic oligonucleotide
acctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaaca

SEQ ID NO: 1924 - DNA, 217 bp, Artificial Sequence
  Synthetic oligonucleotide
atacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtg

SEQ ID NO: 1925 - DNA, 172 bp, Artificial Sequence
  Synthetic oligonucleotide
gcactttgcgaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcag

SEQ ID NO: 1926 - DNA, 177 bp, Artificial Sequence
  Synthetic oligonucleotide
gaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggag

SEQ ID NO: 1927 - DNA, 147 bp, Artificial Sequence
  Synthetic oligonucleotide
gtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccag

SEQ ID NO: 1928 - DNA, 167 bp, Artificial Sequence
  Synthetic oligonucleotide
ttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactg

SEQ ID NO: 1929 - DNA, 261 bp, Artificial Sequence
  Synthetic oligonucleotide
gtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactg

SEQ ID NO: 1930 - DNA, 370 bp, Artificial Sequence
  Synthetic oligonucleotide
tggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagg

SEQ ID NO: 1931 - DNA, 187 bp, Artificial Sequence
  Synthetic oligonucleotide
tgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctgattgtgtta

SEQ ID NO: 1932 - DNA, 17 bp, Artificial Sequence
  Synthetic oligonucleotide
atctgaggcgaggctag

SEQ ID NO: 1933 - DNA, 107 bp, Artificial Sequence
  Synthetic oligonucleotide
gttcttgatacatatttgccagacttcaagatttcagaaaaggggtgaaagagaagattgcaactttgagtcagacctgtaggcctgatagactgattaaaccacag

SEQ ID NO: 1934 - DNA, 91 bp, Artificial Sequence
  Synthetic oligonucleotide
ttgacaacacttactacaaagaggcagaaaaagaaaatcttgtggaacaatccattccgtcaaatgcttgttcttccctggaagttgaggc

SEQ ID NO: 1935 - DNA, 36 bp, Artificial Sequence
  Synthetic oligonucleotide
agccatatcaagaaaaactccagcccagcctcagag

SEQ ID NO: 1936 - DNA, 77 bp, Artificial Sequence
  Synthetic oligonucleotide
ttctaacaacaaaaagaagccagaggaagaaggcagtgctcatcaagatactgctgaaaagaatgcatcttccccag

SEQ ID NO: 1937 - DNA, 46 bp, Artificial Sequence
  Synthetic oligonucleotide
agaaagccaagggtagacatactgtgccttgtatgccacctgcaaa

SEQ ID NO: 1938 - DNA, 96 bp, Artificial Sequence
  Synthetic oligonucleotide
ggtgttcctgaaaagaaggtacttccaatcaccgtccccaagtcaccagcctttgcattgaagaacagaattcgaatgcccaccaaagaagatgag

SEQ ID NO: 1939 - DNA, 57 bp, Artificial Sequence
  Synthetic oligonucleotide
gtaggggatggggagagcagccaaaatgttaattgcttggttggttgattgtacagg

SEQ ID NO: 1940 - DNA, 112 bp, Artificial Sequence
  Synthetic oligonucleotide
ctggaagaagaactgagacagcagaaagaagcagcttgtttcaaggctcgtccaaacaccgtcatctctcaggagccctttgttcccaagaaagagaagaaatcagttgctg

SEQ ID NO: 1941 - DNA, 21 bp, Artificial Sequence
  Synthetic oligonucleotide
agggcctttctggttctctag

SEQ ID NO: 1942 - DNA, 26 bp, Artificial Sequence
  Synthetic oligonucleotide
gtagaaaacctcaccaactgcaccag

SEQ ID NO: 1943 - DNA, 1518 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgtgcataacacgcacggagggct

SEQ ID NO: 1944 - DNA, 1345 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgtgcataacacgcacggagggct

SEQ ID NO: 1945 - DNA, 1622 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgtgcataacacgcacggagggct

SEQ ID NO: 1946 - DNA, 1396 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggatgtcctggtctggccttctccatggcctcaacacgtccctaacttgtggtaagtgggggacttgggcttcagggacgaggctagagggggagggttattcgctcttggacttgtgtgcctccgtcggagccccgagggaaacgggggtggaaaaacacggtggggttttggcagagctagggctgctagagcaagaggtgggaagcagctgcatggagggctactgcgtgtcaagcggcgtttgggtcagttttattatttatttatttaagatctccctctgtcgcccaggctgaagtgcagcggtgtgatcacagctcactgcagtctcgacctcctgggctcaagtgatcctcccgcctcagcctcccaagtagctgggaccacaggcctgcagaaccacaaccagctaactttttgattctttgtagagagggaggtctccctgtgtcgcccagtctggccttaactcctgagctcaagtgaccctccacagcctccaaaagtgctaggattacatgcatgagccactgagcctactattattttaaacagcattaaaaataatgcttcctggccagccgtggtggctcacgcctgtaatcccagcactttgagaggccgaggtcaggagttcgagaccagcctgaccaacatggtgaaaccc

SEQ ID NO: 1947 - DNA, 1119 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggtaagtgggggacttgggcttcagggacgaggctagagggggagggttattcgctcttggacttgtgtgcctccgtcggagccccgagggaaacgggggtggaaaaacacggtggggttttggcagagctagggctgctagagcaagaggtgggaagcagctgcatggagggctactgcgtgtcaagcggcgtttgggtcagttttattatttatttatttaagatctccctctgtcgcccaggctgaagtgcagcggtgtgatcacagctcactgcagtctcgacctcctgggctcaagtgatcctcccgcctcagcctcccaagtagctgggaccacaggcctgcagaaccacaaccagctaactttttgattctttgtagagagggaggtctccctgtgtcgcccagtctggccttaactcctgagctcaagtgaccctccacagcctccaaaagtgctaggattacatgcatgagccactgagcctactattattttaaacagcattaaaaataatgcttcctggccagccgtggtggctcacgcctgtaatcccagcactttgagaggccgaggtcaggagttcgagaccagcctgaccaacatggtgaaaccc

SEQ ID NO: 1948 - DNA, 432 bp, Artificial Sequence
  Synthetic oligonucleotide
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgag

SEQ ID NO: 1949 - DNA, 173 bp, Artificial Sequence
  Synthetic oligonucleotide
gtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagag

SEQ ID NO: 1950 - DNA, 619 bp, Artificial Sequence
  Synthetic oligonucleotide
gtaagtgggggacttgggcttcagggacgaggctagagggggagggttattcgctcttggacttgtgtgcctccgtcggagccccgagggaaacgggggtggaaaaacacggtggggttttggcagagctagggctgctagagcaagaggtgggaagcagctgcatggagggctactgcgtgtcaagcggcgtttgggtcagttttattatttatttatttaagatctccctctgtcgcccaggctgaagtgcagcggtgtgatcacagctcactgcagtctcgacctcctgggctcaagtgatcctcccgcctcagcctcccaagtagctgggaccacaggcctgcagaaccacaaccagctaactttttgattctttgtagagagggaggtctccctgtgtcgcccagtctggccttaactcctgagctcaagtgaccctccacagcctccaaaagtgctaggattacatgcatgagccactgagcctactattattttaaacagcattaaaaataatgcttcctggccagccgtggtggctcacgcctgtaatcccagcactttgagaggccgaggtcaggagttcgagaccagcctgaccaacatggtgaaaccc

SEQ ID NO: 1951 - DNA, 250 bp, Artificial Sequence
  Synthetic oligonucleotide
tggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcct

SEQ ID NO: 1952 - DNA, 153 bp, Artificial Sequence
  Synthetic oligonucleotide
cttgtggagtatttgccctctgtgtggctgtggcagtggacatctctgagcttcagtttcctccagaaaatagctccattggtggtatctcctttgtttggtttggtgaagattaaattcgatgctctatgtgcataacacgcacggagggct

SEQ ID NO: 1953 - DNA, 104 bp, Artificial Sequence
  Synthetic oligonucleotide
gtatttcctttgatttaagccagaaagtcctgagagcggatcggggagcatttgcggatcggtcactttttcctcctttctgagtctcttatcccctaccacag

SEQ ID NO: 1954 - DNA, 68 bp, Artificial Sequence
  Synthetic oligonucleotide
ggacggcccaggtggcaggatgtcctggtctggccttctccatggcctcaacacgtccctaacttgtg

SEQ ID NO: 1955 - DNA, 75 bp, Artificial Sequence
  Synthetic oligonucleotide
gcccagctctggttccccggctctgggctacctgctccatggctaccctgaaccagatgcaccgcctggggcccc

SEQ ID NO: 1956 - DNA, 45 bp, Artificial Sequence
  Synthetic oligonucleotide
ccaagcggccgcctcggaagctgggccccacggaaggccggccgc

SEQ ID NO: 1957 - DNA, 25 bp, Artificial Sequence
  Synthetic oligonucleotide
agctgaagggtgtggtcctgtgcac

SEQ ID NO: 1958 - DNA, 66 bp, Artificial Sequence
  Synthetic oligonucleotide
gtttacccgcaagccgaagaagcccaactcagccaatcgcaagtgctgtcgagtgcggctcagcac

SEQ ID NO: 1959 - DNA, 108 bp, Artificial Sequence
  Synthetic oligonucleotide
ctagaggcagccactcatggattcaagtcctggctccgcctcttccatcaggaccactattaagccataggagtcctgggggtgcaaagggtgcccctctgtcaacac

SEQ ID NO: 1960 - DNA, 118 bp, Artificial Sequence
  Synthetic oligonucleotide
ccttggctcctgtgtttagaggggtggcctgaaggaccttttctgctgggacaagacactgtactgccctctgctgggaaggggttttaataaacagaccctggcgcttgtgatgtaa

SEQ ID NO: 1961 - DNA, 5 bp, Artificial Sequence
  Synthetic oligonucleotide
atccc

SEQ ID NO: 1962 - DNA, 2761 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1963 - DNA, 2674 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1964 - DNA, 3031 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1965 - DNA, 3196 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1966 - DNA, 2391 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1967 - DNA, 2757 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1968 - DNA, 3163 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1969 - DNA, 2914 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1970 - DNA, 3316 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1971 - DNA, 2441 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1972 - DNA, 2626 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctggcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1973 - DNA, 3433 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1974 - DNA, 2743 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1975 - DNA, 2670 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1976 - DNA, 1962 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaagcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1977 - DNA, 2663 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1978 - DNA, 2410 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1979 - DNA, 1220 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggtgagatgcgactctcctgggatgg

SEQ ID NO: 1980 - DNA, 2300 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1981 - DNA, 2350 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccagggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1982 - DNA, 2219 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1983 - DNA, 2262 bp, Homo sapiens
ggcgggcagatcacgaggtcaggagatcgagaccatcctggctaacatggtgaaaccccatctctactaaatatacaaaaaattagccgggcatggtggcgggcacctgtagtcccagctactcgggaggctgaggcaggagaatggtgtgaacccgggatgcggagcttgcagtgagccaagatcgcgccactggactccatcctgggtgacagagcgagactccgtatcaaaaaaaaaaataggaagacaaagggggcggggatcactcttccacctttttcttcttcacaggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1984 - DNA, 1455 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1985 - DNA, 1296 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactttgcagcacttcttttataacatgtatataccttggcttgagtctgttacctgtctatagtttgatgatagcctcttgaggataggggctttgtcttattcttatgggaccccagtgcttagaatagtgtcttatgtaacattctatgaacatttggtgaccaggtgtggtggctcacgcctgtaattccaacactcctccgaggcaggaggatcatttgagctcaggagtttgagaccagcctaggcaacatagtgagaccccatctctttttctctttttttttttcttttcttttttttttgtggagacagagtcttactctatccctcaggctagagtacagtggcatgatctcggctcactgcaacatccacctcccaggttcaagcgattctcatgcctcaccccgagtacctgggattaccagcacctgccaccacac

SEQ ID NO: 1986 - DNA, 786 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1987 - DNA, 862 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1988 - DNA, 1489 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactttgcagcacttcttttataacatgtatataccttggcttgagtctgttacctgtctatagtttgatgatagcctcttgaggataggggctttgtcttattcttatgggaccccagtgcttagaatagtgtcttatgtaacattctatgaacatttggtgaccaggtgtggtggctcacgcctgtaattccaacactcctccgaggcaggaggatcatttgagctcaggagtttgagaccagcctaggcaacatagtgagaccccatctctttttctctttttttttttcttttcttttttttttgtggagacagagtcttactctatccctcaggctagagtacagtggcatgatctcggctcactgcaacatccacctcccaggttcaagcgattctcatgcctcaccccgagtacctgggattaccagcacctgccaccacac

SEQ ID NO: 1989 - DNA, 1420 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaagcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1990 - DNA, 1372 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactttgcagcacttcttttataacatgtatataccttggcttgagtctgttacctgtctatagtttgatgatagcctcttgaggataggggctttgtcttattcttatgggaccccagtgcttagaatagtgtcttatgtaacattctatgaacatttggtgaccaggtgtggtggctcacgcctgtaattccaacactcctccgaggcaggaggatcatttgagctcaggagtttgagaccagcctaggcaacatagtgagaccccatctctttttctctttttttttttcttttcttttttttttgtggagacagagtcttactctatccctcaggctagagtacagtggcatgatctcggctcactgcaacatccacctcccaggttcaagcgattctcatgcctcaccccgagtacctgggattaccagcacctgccaccacac

SEQ ID NO: 1991 - DNA, 805 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1992 - DNA, 979 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1993 - DNA, 965 bp, Homo sapiens
tctatttcttaaaaaaaaaaaaaaaaaataagccaaattcaattgaatgagtctcttgctcaccttgtacctcaaagttcctatgctaggggccctatccccctcagccttcccccttcctttttcctttctccttcttttcctttgcagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1994 - DNA, 695 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1995 - DNA, 845 bp, Homo sapiens
cccgttaggggttaccccttccatcttaagcaggatattctaggatctctcagtctcacagccttgcccaccaataaccagcagaaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccgcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 1996 - DNA, 143 bp, Artificial Sequence
  Synthetic oligonucleotide
aaagcggttcgacaattggtccttcttttggcccctcctgcgatgcccgcggattggacggctgagtctggctacgcgggcctccgcgggagcgcgaccgggccaatcaagagcttggcgtattttacaaactgagaaagtag

SEQ ID NO: 1997 - DNA, 652 bp, Artificial Sequence
  Synthetic oligonucleotide
catggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatcagttgctctgtgttctcctaatactttgcagcacttcttttataacatgtatataccttggcttgagtctgttacctgtctatagtttgatgatagcctcttgaggataggggctttgtcttattcttatgggaccccagtgcttagaatagtgtcttatgtaacattctatgaacatttggtgaccaggtgtggtggctcacgcctgtaattccaacactcctccgaggcaggaggatcatttgagctcaggagtttgagaccagcctaggcaacatagtgagaccccatctctttttctctttttttttttcttttcttttttttttgtggagacagagtcttactctatccctcaggctagagtacagtggcatgatctcggctcactgcaacatccacctcccaggttcaagcgattctcatgcctcaccccgagtacctgggattaccagcacctgccaccacac

SEQ ID NO: 1998 - DNA, 150 bp, Artificial Sequence
  Synthetic oligonucleotide
tctatttcttaaaaaaaaaaaaaaaaaataagccaaattcaattgaatgagtctcttgctcaccttgtacctcaaagttcctatgctaggggccctatccccctcagccttcccccttcctttttcctttctccttcttttcctttgcag

SEQ ID NO: 1999 - DNA, 138 bp, Artificial Sequence
  Synthetic oligonucleotide
ggtgttcgggcctctgcatatttggcccccagaacccccacccaccgactggaccctgccagggcttcctgcttctctaggctggagggaccaggacctcgaggccggacattgtgcccccagaggctacaggctctg

SEQ ID NO: 2000 - DNA, 294 bp, Artificial Sequence
  Synthetic oligonucleotide
ggcgggcagatcacgaggtcaggagatcgagaccatcctggctaacatggtgaaaccccatctctactaaatatacaaaaaattagccgggcatggtggcgggcacctgtagtcccagctactcgggaggctgaggcaggagaatggtgtgaacccgggatgcggagcttgcagtgagccaagatcgcgccactggactccatcctgggtgacagagcgagactccgtatcaaaaaaaaaaataggaagacaaagggggcggggatcactcttccacctttttcttcttcacag

SEQ ID NO: 2001 - DNA, 129 bp, Artificial Sequence
  Synthetic oligonucleotide
gacagccatgactcccacctgatgccctcccctgcccctgtggcccagcccttgcctggccatgtggtgccatgtccatcaccctttggacgggctcagcgtgtaccctccccaggccctccaactctg

SEQ ID NO: 2002 - DNA, 402 bp, Artificial Sequence
  Synthetic oligonucleotide
gtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacag

SEQ ID NO: 2003 - DNA, 135 bp, Artificial Sequence
  Synthetic oligonucleotide
gagcaggttgccgtccggttgtttgaccaggagagttgtataaggtcactggagggttctgggaaaccaccggtggccactccttctggaccccactctaacagaacccccagcctccaggaggtgaagattcaa

SEQ ID NO: 2004 - DNA, 153 bp, Artificial Sequence
  Synthetic oligonucleotide
gtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacag

SEQ ID NO: 2005 - DNA, 284 bp, Artificial Sequence
  Synthetic oligonucleotide
cgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtag

SEQ ID NO: 2006 - DNA, 139 bp, Artificial Sequence
  Synthetic oligonucleotide
ctagggtagagctgggggcatcagagccctgcaccctggaacatagaagtctagagtccagtctaccaccctgctgcagtcagtgggctccagcaaccaccagcctgatcttctcttcccaacacccgctttgtgccag

SEQ ID NO: 2007 - DNA, 270 bp, Artificial Sequence
  Synthetic oligonucleotide
gtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcag

SEQ ID NO: 2008 - DNA, 194 bp, Artificial Sequence
  Synthetic oligonucleotide
gcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctg

SEQ ID NO: 2009 - DNA, 165 bp, Artificial Sequence
  Synthetic oligonucleotide
gtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccag

SEQ ID NO: 2010 - DNA, 165 bp, Artificial Sequence
  Synthetic oligonucleotide
tgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagtaaaacac

SEQ ID NO: 2011 - DNA, 84 bp, Artificial Sequence
  Synthetic oligonucleotide
cccgttaggggttaccccttccatcttaagcaggatattctaggatctctcagtctcacagccttgcccaccaataaccagcag

SEQ ID NO: 2012 - DNA, 71 bp, Artificial Sequence
  Synthetic oligonucleotide
ctccagcagcacccgagagggtcaggagaaaagcggaggaagctgggtaggccctgaggggcctcggtaag

SEQ ID NO: 2013 - DNA, 60 bp, Artificial Sequence
  Synthetic oligonucleotide
ccatcatgaccacccggcaagccacgaaggatcccctcctccggggtgtatctcctaccc

SEQ ID NO: 2014 - DNA, 89 bp, Artificial Sequence
  Synthetic oligonucleotide
ctagcaagattccggtacgctctcagaaacgcacgcctttccccactgttacatcgtgcgccgtggaccaggagaaccaagatccaagg

SEQ ID NO: 2015 - DNA, 39 bp, Artificial Sequence
  Synthetic oligonucleotide
agatgggtgcagaaaccaccgctcaatattcaacgcccc

SEQ ID NO: 2016 - DNA, 20 bp, Artificial Sequence
  Synthetic oligonucleotide
ctcgttgattcagcaggccc

SEQ ID NO: 2017 - DNA, 43 bp, Artificial Sequence
  Synthetic oligonucleotide
caggccgaaagccaggcaccaggcagagacatcacaaagattg

SEQ ID NO: 2018 - DNA, 26 bp, Artificial Sequence
  Synthetic oligonucleotide
gtggggatcagtcagcctcggaaccc

SEQ ID NO: 2019 - DNA, 65 bp, Artificial Sequence
  Synthetic oligonucleotide
cttggaagagctcaggcctagccctaggggtcaaaatgtggggcctgggccccctgcccagacag

SEQ ID NO: 2020 - DNA, 105 bp, Artificial Sequence
  Synthetic oligonucleotide
gtacctgttggagccatggtaacacggcctccatggctgagtaggggactaggaagggtaaaagtggggttttggggttttgcactcactcctgctgtctcctac

SEQ ID NO: 2021 - DNA, 12 bp, Artificial Sequence
  Synthetic oligonucleotide
ttactgtgatag

SEQ ID NO: 2022 - DNA, 57 bp, Artificial Sequence
  Synthetic oligonucleotide
tcctggtcccagctcctggaaagctctttgctcttagaagatctccctttcctccag

SEQ ID NO: 2023 - DNA, 19 bp, Artificial Sequence
  Synthetic oligonucleotide
caaaatgtcatctcgccag

SEQ ID NO: 2024 - DNA, 4 bp, Artificial Sequence
  Synthetic oligonucleotide
gtgc

SEQ ID NO: 2025 - DNA, 60 bp, Artificial Sequence
  Synthetic oligonucleotide
aggctccagggaccatagagtttgtggctgaccctgcagccctggccaccatcctgtcag

SEQ ID NO: 2026 - DNA, 98 bp, Artificial Sequence
  Synthetic oligonucleotide
gtgagggtgtgaagagctgtcacctggggcgccagcctagtctggctaaaagagtactggttcgaggaagtcagggaggcaccacccagagggtccag

SEQ ID NO: 2027 - DNA, 83 bp, Artificial Sequence
  Synthetic oligonucleotide
atttcaccttcaggaccttcctttcacccttccactcgccccagtttccaggagctaagaagggagacagctggcagcagccg

SEQ ID NO: 2028 - DNA, 54 bp, Artificial Sequence
  Synthetic oligonucleotide
gacttcagtgagccagggcctcaggattgctcctggagaccccagtccagcctg

SEQ ID NO: 2029 - DNA, 18 bp, Artificial Sequence
  Synthetic oligonucleotide
ctttctctcttcctaaag

SEQ ID NO: 2030 - DNA, 104 bp, Artificial Sequence
  Synthetic oligonucleotide
gagaacgcgaggttgtcactcactcagatgaaggaggtgtggcctctcttggtctggcccagcgagtaccattaagagaaaaccgagaaatgtcacataccagg

SEQ ID NO: 2031 - DNA, 25 bp, Artificial Sequence
  Synthetic oligonucleotide
gtgagatgcgactctcctgggatgg

SEQ ID NO: 2032 - DNA, 84 bp, Artificial Sequence
  Synthetic oligonucleotide
acctcatattcagtgttgcggcgtctcaccgttcaacctaaaacccggttcacacccatgccatcaacccccagagttcagcag

SEQ ID NO: 2033 - DNA, 60 bp, Artificial Sequence
  Synthetic oligonucleotide
gcccagtggctgcgtggtgtctcccctcagtcctgctctgaagatcctgccctgccctgg

SEQ ID NO: 2034 - DNA, 17 bp, Artificial Sequence
  Synthetic oligonucleotide
gagtgagcctgagatac

SEQ ID NO: 2035 - DNA, 82 bp, Artificial Sequence
  Synthetic oligonucleotide
cagagccctccctccaggaacagcttgaagtaccagagccctaccctccagcagaacccaggcccctagagtcctgctgtag

SEQ ID NO: 2036 - DNA, 46 bp, Artificial Sequence
  Synthetic oligonucleotide
gagtgagcctgagataccggagtcctctcgccaggaacagcttgag

SEQ ID NO: 2037 - DNA, 87 bp, Artificial Sequence
  Synthetic oligonucleotide
gtacctgagccctgccctccagcagaacccaggcccctagagtcctactgtaggattgagcctgagataccggagtcctctcgccag

SEQ ID NO: 2038 - DNA, 12 bp, Artificial Sequence
  Synthetic oligonucleotide
gaacagcttgag

SEQ ID NO: 2039 - DNA, 82 bp, Artificial Sequence
  Synthetic oligonucleotide
gtacctgagccctgccctccagcagaacccgggccccttcagcccagcacccaggggcagtctggacccccagggccctgcc

SEQ ID NO: 2040 - DNA, 22 bp, Artificial Sequence
  Synthetic oligonucleotide
cccccctatctgctcactccag

SEQ ID NO: 2041 - DNA, 24 bp, Artificial Sequence
  Synthetic oligonucleotide
tctttgagacccccagcaggccag

SEQ ID NO: 2042 - DNA, 4 bp, Artificial Sequence
  Synthetic oligonucleotide
gcag

SEQ ID NO: 2043 - DNA, 2600 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccgttctttttctaattccaaataaacttgcaagaggactatgaaagattatgatgaacttctcaaatattatgaattacatgaaactattgggacagagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2044 - DNA, 2686 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccgttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2045 - DNA, 2769 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccaatctcgctccgttgcccaggctggagtgcagtggcgtgatctcggctcactgcaacctctgcctcctgcctcagcctcccaagttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2046 - DNA, 2625 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccaatctcgctccgttgcccaggctggagtgcagtggcgtgatctcggctcactgcaacctctgcctcctgcctcagcctcccaagttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2047 - DNA, 2748 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccaatctcgctccgttgcccaggctggagtgcagtggcgtgatctcggctcactgcaacctctgcctcctgcctcagcctcccaagttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagagacggagtttcgctcttgttgcccaggctggagtgcaatggtgtgatcttggctcactgcaacctctgcctcccgagttcaagcgattctcctgcctcagcctcccgaattgctggaattacaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2048 - DNA, 2241 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccaatctcgctccgttgcccaggctggagtgcagtggcgtgatctcggctcactgcaacctctgcctcctgcctcagcctcccaagttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2049 - DNA, 2137 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccaatctcgctccgttgcccaggctggagtgcagtggcgtgatctcggctcactgcaacctctgcctcctgcctcagcctcccaagttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2050 - DNA, 145 bp, Artificial Sequence
  Synthetic oligonucleotide
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcag

SEQ ID NO: 2051 - DNA, 191 bp, Artificial Sequence
  Synthetic oligonucleotide
gtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctcc

SEQ ID NO: 2052 - DNA, 132 bp, Artificial Sequence
  Synthetic oligonucleotide
tggcagtatgatcacctcacggctacctatcttctgcttctagccaagaaggctcggggaaaaccagttcgtttaaggctttcttctttctcctgtggacaagccagtgctaccccattcacagacatcaag

SEQ ID NO: 2053 - DNA, 123 bp, Artificial Sequence
  Synthetic oligonucleotide
tcaaataattggagtctggaagatgtgaccgcaagtgataaaaattatgtggcgggattaatagactatgattggtgtgaagatgatttatcaacaggtgctgctactccccgaacatcacag

SEQ ID NO: 2054 - DNA, 232 bp, Artificial Sequence
  Synthetic oligonucleotide
tttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaag

SEQ ID NO: 2055 - DNA, 169 bp, Artificial Sequence
  Synthetic oligonucleotide
gtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaag

SEQ ID NO: 2056 - DNA, 534 bp, Artificial Sequence
  Synthetic oligonucleotide
ttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaattctc

SEQ ID NO: 2057 - DNA, 83 bp, Artificial Sequence
  Synthetic oligonucleotide
aatctcgctccgttgcccaggctggagtgcagtggcgtgatctcggctcactgcaacctctgcctcctgcctcagcctcccaa

SEQ ID NO: 2058 - DNA, 96 bp, Artificial Sequence
  Synthetic oligonucleotide
gttctttttctaattccaaataaacttgcaagaggactatgaaagattatgatgaacttctcaaatattatgaattacatgaaactattgggacag

SEQ ID NO: 2059 - DNA, 86 bp, Artificial Sequence
  Synthetic oligonucleotide
gtggctttgcaaaggtcaaacttgcctgccatatccttactggagagatggtagctataaaaatcatggataaaaacacactaggg

SEQ ID NO: 2060 - DNA, 117 bp, Artificial Sequence
  Synthetic oligonucleotide
agtgatttgccccggatcaaaacggagattgaggccttgaagaacctgagacatcagcatatatgtcaactctaccatgtgctagagacagccaacaaaatattcatggttcttgag

SEQ ID NO: 2061 - DNA, 42 bp, Artificial Sequence
  Synthetic oligonucleotide
tactgccctggaggagagctgtttgactatataatttcccag

SEQ ID NO: 2062 - DNA, 102 bp, Artificial Sequence
  Synthetic oligonucleotide
gatcgcctgtcagaagaggagacccgggttgtcttccgtcagatagtatctgctgttgcttatgtgcacagccagggctatgctcacagggacctcaagcca

SEQ ID NO: 2063 - DNA, 69 bp, Artificial Sequence
  Synthetic oligonucleotide
gaaaatttgctgtttgatgaatatcataaattaaagctgattgactttggtctctgtgcaaaacccaag

SEQ ID NO: 2064 - DNA, 93 bp, Artificial Sequence
  Synthetic oligonucleotide
ggtaacaaggattaccatctacagacatgctgtgggagtctggcttatgcagcacctgagttaatacaaggcaaatcatatcttggatcagag

SEQ ID NO: 2065 - DNA, 25 bp, Artificial Sequence
  Synthetic oligonucleotide
acggagtttcgctcttgttgcccag

SEQ ID NO: 2066 - DNA, 98 bp, Artificial Sequence
  Synthetic oligonucleotide
gctggagtgcaatggtgtgatcttggctcactgcaacctctgcctcccgagttcaagcgattctcctgcctcagcctcccgaattgctggaattacag

SEQ ID NO: 2067 - DNA, 99 bp, Artificial Sequence
  Synthetic oligonucleotide
gcagatgtttggagcatgggcatactgttatatgttcttatgtgtggatttctaccatttgatgatgataatgtaatggctttatacaagaagattatg

SEQ ID NO: 2068 - DNA, 69 bp, Artificial Sequence
  Synthetic oligonucleotide
agaggaaaatatgatgttcccaagtggctctctcccagtagcattctgcttcttcaacaaatgctgcag

SEQ ID NO: 2069 - DNA, 99 bp, Artificial Sequence
  Synthetic oligonucleotide
gtggacccaaagaaacggatttctatgaaaaatctattgaaccatccctggatcatgcaagattacaactatcctgttgagtggcaaagcaagaatcct

SEQ ID NO: 2070 - DNA, 87 bp, Artificial Sequence
  Synthetic oligonucleotide
tttattcacctcgatgatgattgcgtaacagaactttctgtacatcacagaaacaacaggcaaacaatggaggatttaatttcactg

SEQ ID NO: 2071 - DNA, 97 bp, Artificial Sequence
  Synthetic oligonucleotide
ctagaaaccagtgcctgaaagaaactccaattaaaataccagtaaattcaacaggaacagacaagttaatgacaggtgtcattagccctgagaggcg

SEQ ID NO: 2072 - DNA, 104 bp, Artificial Sequence
  Synthetic oligonucleotide
cttcactataatgtgactacaactagattagtgaatccagatcaactgttgaatgaaataatgtctattcttccaaagaagcatgttgactttgtacaaaaggg

SEQ ID NO: 2073 - DNA, 3265 bp, Homo sapiens
agaacctgagagtgcagtcctgcccagggcacaactggaaggctgtgggggaagggagacacccattgtggaaatgggtgcggcctgccttcagtcttgggggtggatggagtaaattatttgaattaagaagtcctaggtggctgggtgcggtggctcacacctgtaatcccaaaactttgggtggccaaggtgggaggattgcttgagcccaggagtttcagaccagcctgggcaacagagcaagaccccatctctactaaaacaaatttaaaaaaattatccaggcgtggtggtgtacacctacagtcccagtttcttgggaggctgaggtaggaggattgcttgagcccaggaggtggaggctgcagtgacccctgcactccagtctgggtgacagttagacacactgcccccgaccccaaaaaaataagtcctaggtatgagtttgagataatgaaaaataaaaatctgattttctaatatttcccctaaaaaacacatgtcatttacataaaataggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccaga

SEQ ID NO: 2074 - DNA, 3862 bp, Homo sapiens
ggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcaggtgagggggagcggcggccaggacatctgggaggtggctagacccgtggcctggactttggggggcggtcgagttggatcgatgatcgatggggaccctggcggcctcaccctgggggaggtagagacgaaaaaggaactacggtgtgcccggaaggtggtggctttaggtccacagggaggtggttggcaaggcgggggtaacagggggaaggagaaaatctgaaatgccggtgtgagctccgggccaagagagttgaggactcaggaggcaggaatcccccgtggccgcccgctgcttggctgtgggctccaacttggtgtgtgctcagagaaggcagtggttggagtgaacagggcctgtgccaggtggggagactagccaaggtgtttgtgcagcctggcctctggagcggcctgggaagagctggagttcgcagggtgggagctgccctgtggctgggagcccgtgctggcgtccctgccaggcggtgatctcacagagacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtggagctgtcttttgctgctaactgcccttgaccgacttcctaccaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccaga

SEQ ID NO: 2075 - DNA, 3517 bp, Homo sapiens
ggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcaggtgagggggagcggcggccaggacatctgggaggtggctagacccgtggcctggactttggggggcggtcgagttggatcgatgatcgatggggaccctggcggcctcaccctgggggaggtagagacgaaaaaggaactacggtgtgcccggaaggtggtggctttaggtccacagggaggtggttggcaaggcgggggtaacagggggaaggagaaaatctgaaatgccggtgtgagctccgggccaagagagttgaggactcaggaggcaggaatcccccgtggccgcccgctgcttggctgtgggctccaacttggtgtgtgctcagagaaggcagtggttggagtgaacagggcctgtgccaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccaga

SEQ ID NO: 2076 - DNA, 3360 bp, Homo sapiens
ggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcagagacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtggagctgtcttttgctgctaactgcccttgaccgacttcctaccaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccaga

SEQ ID NO: 2077 - DNA, 3149 bp, Homo sapiens
ggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccaga

SEQ ID NO: 2078 - DNA, 3368 bp, Homo sapiens
agaacctgagagtgcagtcctgcccagggcacaactggaaggctgtgggggaagggagacacccattgtggaaatgggtgcggcctgccttcagtcttgggggtggatggagtaaattatttgaattaagaagtcctaggtggctgggtgcggtggctcacacctgtaatcccaaaactttgggtggccaaggtgggaggattgcttgagcccaggagtttcagaccagcctgggcaacagagcaagaccccatctctactaaaacaaatttaaaaaaattatccaggcgtggtggtgtacacctacagtcccagtttcttgggaggctgaggtaggaggattgcttgagcccaggaggtggaggctgcagtgacccctgcactccagtctgggtgacagttagacacactgcccccgaccccaaaaaaataagtcctaggtatgagtttgagataatgaaaaataaaaatctgattttctaatatttcccctaaaaaacacatgtcatttacataaaataggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaaggtgaggctgctgctgggcccgcggccctgggcgggggggcttgtgctcctcctacctggaagtacagctgggtgctgactgcagacctctctcccctgcacagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccaga

SEQ ID NO: 2079 - DNA, 467 bp, Artificial Sequence
  Synthetic oligonucleotide
ggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcag

SEQ ID NO: 2080 - DNA, 368 bp, Artificial Sequence
  Synthetic oligonucleotide
gtgagggggagcggcggccaggacatctgggaggtggctagacccgtggcctggactttggggggcggtcgagttggatcgatgatcgatggggaccctggcggcctcaccctgggggaggtagagacgaaaaaggaactacggtgtgcccggaaggtggtggctttaggtccacagggaggtggttggcaaggcgggggtaacagggggaaggagaaaatctgaaatgccggtgtgagctccgggccaagagagttgaggactcaggaggcaggaatcccccgtggccgcccgctgcttggctgtgggctccaacttggtgtgtgctcagagaaggcagtggttggagtgaacagggcctgtgccag

SEQ ID NO: 2081 - DNA, 134 bp, Artificial Sequence
  Synthetic oligonucleotide
gtggggagactagccaaggtgtttgtgcagcctggcctctggagcggcctgggaagagctggagttcgcagggtgggagctgccctgtggctgggagcccgtgctggcgtccctgccaggcggtgatctcacag

SEQ ID NO: 2082 - DNA, 211 bp, Artificial Sequence
  Synthetic oligonucleotide
agacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtggagctgtcttttgctgctaactgcccttgaccgacttcctaccag

SEQ ID NO: 2083 - DNA, 522 bp, Artificial Sequence
  Synthetic oligonucleotide
agaacctgagagtgcagtcctgcccagggcacaactggaaggctgtgggggaagggagacacccattgtggaaatgggtgcggcctgccttcagtcttgggggtggatggagtaaattatttgaattaagaagtcctaggtggctgggtgcggtggctcacacctgtaatcccaaaactttgggtggccaaggtgggaggattgcttgagcccaggagtttcagaccagcctgggcaacagagcaagaccccatctctactaaaacaaatttaaaaaaattatccaggcgtggtggtgtacacctacagtcccagtttcttgggaggctgaggtaggaggattgcttgagcccaggaggtggaggctgcagtgacccctgcactccagtctgggtgacagttagacacactgcccccgaccccaaaaaaataagtcctaggtatgagtttgagataatgaaaaataaaaatctgattttctaatatttcccctaaaaaacacatgtcatttacataaaatag

SEQ ID NO: 2084 - DNA, 124 bp, Artificial Sequence
  Synthetic oligonucleotide
gtccttccaatggctgtgtgtttaaagattgtgggagcttcgctgaacgttaatgtgtagtaaatgcacctccttgtattcccactttcgtagtcatttcggttctgatcttgtcaaacccagc

SEQ ID NO: 2085 - DNA, 331 bp, Artificial Sequence
  Synthetic oligonucleotide
ctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgta

SEQ ID NO: 2086 - DNA, 409 bp, Artificial Sequence
  Synthetic oligonucleotide
aagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgac

SEQ ID NO: 2087 - DNA, 186 bp, Artificial Sequence
  Synthetic oligonucleotide
gtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgc

SEQ ID NO: 2088 - DNA, 187 bp, Artificial Sequence
  Synthetic oligonucleotide
agcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccaca

SEQ ID NO: 2089 - DNA, 123 bp, Artificial Sequence
  Synthetic oligonucleotide
ctggcccacatagctccatcccatacgggtagctggctccagctgcgccaaggtgcagacccgccctgggcatgctggcctgtgacggagcctgaggtcacagccccctgactagcctgagac

SEQ ID NO: 2090 - DNA, 132 bp, Artificial Sequence
  Synthetic oligonucleotide
cttacggggcggccagtccttgcccacaacgatgtggagccctgtgaaagtcggattcgaataaagggccacgtgtgcacccagaaaaaaaagtctgtggttcaggggggtctgtcggcggagcggggccac

SEQ ID NO: 2091 - DNA, 61 bp, Artificial Sequence
  Synthetic oligonucleotide
gaagcggggagaggtggtgagagatgacccctgttgaggatttcattggtgtctgccacag

SEQ ID NO: 2092 - DNA, 109 bp, Artificial Sequence
  Synthetic oligonucleotide
gccgccatggcatcagatgaaggcaaactttttgttggagggctgagttttgacaccaatgagcagtcgctggagcaggtcttctcaaagtacggacagatctctgaag

SEQ ID NO: 2093 - DNA, 67 bp, Artificial Sequence
  Synthetic oligonucleotide
gtgaggctgctgctgggcccgcggccctgggcgggggggcttgtgctcctcctacctggaagtacag

SEQ ID NO: 2094 - DNA, 17 bp, Artificial Sequence
  Synthetic oligonucleotide
ctgggtgctgactgcag

SEQ ID NO: 2095 - DNA, 19 bp, Artificial Sequence
  Synthetic oligonucleotide
acctctctcccctgcacag

SEQ ID NO: 2096 - DNA, 107 bp, Artificial Sequence
  Synthetic oligonucleotide
tggtggttgtgaaagacagggagacccagagatctcggggatttgggtttgtcacctttgagaacattgacgacgctaaggatgccatgatggccatgaatgggaag

SEQ ID NO: 2097 - DNA, 24 bp, Artificial Sequence
  Synthetic oligonucleotide
tctgtagatggacggcagatccga

SEQ ID NO: 2098 - DNA, 9 bp, Artificial Sequence
  Synthetic oligonucleotide
gtagaccag

SEQ ID NO: 2099 - DNA, 4 bp, Artificial Sequence
  Synthetic oligonucleotide
gcag

SEQ ID NO: 2100 - DNA, 24 bp, Artificial Sequence
  Synthetic oligonucleotide
gcaagtcgtcagacaaccgatccc

SEQ ID NO: 2101 - DNA, 12 bp, Artificial Sequence
  Synthetic oligonucleotide
gtgggtaccgtg

SEQ ID NO: 2102 - DNA, 30 bp, Artificial Sequence
  Synthetic oligonucleotide
gtggctctgccgggggccggggcttcttcc

SEQ ID NO: 2103 - DNA, 12 bp, Artificial Sequence
  Synthetic oligonucleotide
gtgggggccgag

SEQ ID NO: 2104 - DNA, 24 bp, Artificial Sequence
  Synthetic oligonucleotide
gacggggccgtgggttctctagag

SEQ ID NO: 2105 - DNA, 37 bp, Artificial Sequence
  Synthetic oligonucleotide
gaggaggggaccgaggctatggggggaaccggttcga

SEQ ID NO: 2106 - DNA, 41 bp, Artificial Sequence
  Synthetic oligonucleotide
gtccaggagtgggggctacggaggctccagagactactata

SEQ ID NO: 2107 - DNA, 4 bp, Artificial Sequence
  Synthetic oligonucleotide
gcag

SEQ ID NO: 2108 - DNA, 71 bp, Artificial Sequence
  Synthetic oligonucleotide
ccggagtcagagtggtggctacagtgaccggagctcgggcgggtcctacagagacagttacgacagttacg

SEQ ID NO: 2109 - DNA, 38 bp, Artificial Sequence
  Synthetic oligonucleotide
ctacacacaacgagtaaaaacccttcctgctcaagatc

SEQ ID NO: 2110 - DNA, 20 bp, Artificial Sequence
  Synthetic oligonucleotide
gtgtggtaggaccccggcgg

SEQ ID NO: 2111 - DNA, 29 bp, Artificial Sequence
  Synthetic oligonucleotide
gtgtggcagcaactgccctggagccccag

SEQ ID NO: 2112 - DNA, 7 bp, Artificial Sequence
  Synthetic oligonucleotide
cccctgc

SEQ ID NO: 2113 - DNA, 4 bp, Artificial Sequence
  Synthetic oligonucleotide
gtcc

SEQ ID NO: 2114 - DNA, 46 bp, Artificial Sequence
  Synthetic oligonucleotide
atctgtgctgtgcgccccacagtagacgtgcagacgtccctgagag

SEQ ID NO: 2115 - DNA, 16 bp, Artificial Sequence
  Synthetic oligonucleotide
gttcttgaagatgttt

SEQ ID NO: 2116 - DNA, 24 bp, Artificial Sequence
  Synthetic oligonucleotide
atttatattgtccttttttactgg

SEQ ID NO: 2117 - DNA, 14 bp, Artificial Sequence
  Synthetic oligonucleotide
ctggactgcctcag

SEQ ID NO: 2118 - DNA, 5 bp, Artificial Sequence
  Synthetic oligonucleotide
tctag

SEQ ID NO: 2119 - DNA, 107 bp, Artificial Sequence
  Synthetic oligonucleotide
aagcaggccagagagcagaggcacgtggcatcccagggcgacctcagacggccagccggttagctagttctgctgttgcttcacgagttctgagcattctctgctag

SEQ ID NO: 2120 - DNA, 115 bp, Artificial Sequence
  Synthetic oligonucleotide
cctatggaagctgcagccctcggaggacagaagtgttgtgcgcccaacagaaccctctgagacgcaagctgctcccttggctagctcatatgtggaaatagccctgtaattcgag

SEQ ID NO: 2121 - DNA, 95 bp, Artificial Sequence
  Synthetic oligonucleotide
cttcctaggggctgtggctgtttccggggaggccgggaggggcagctgtgagccctgtggaggacgttgggagtaacgctgctttgctttggcag

SEQ ID NO: 2122 - DNA, 44 bp, Artificial Sequence
  Synthetic oligonucleotide
gttgaaggggcccggccaggactcggggaagggtggcctgagag

SEQ ID NO: 2123 - DNA, 10 bp, Artificial Sequence
  Synthetic oligonucleotide
cagcgatgac

SEQ ID NO: 2124 - DNA, 32 bp, Artificial Sequence
  Synthetic oligonucleotide
ctctggggtcactgtcccaggagggacttcac

SEQ ID NO: 2125 - DNA, 48 bp, Artificial Sequence
  Synthetic oligonucleotide
ctggaacaagagctggaggcagccgcttgcccaggaggcttgtcccct

SEQ ID NO: 2126 - DNA, 34 bp, Artificial Sequence
  Synthetic oligonucleotide
gaggcgcttcgccagtgaggtgcgggctcagggc

SEQ ID NO: 2127 - DNA, 41 bp, Artificial Sequence
  Synthetic oligonucleotide
ctcgagtctctcctggagcacgggctgcggtgcgccggcag

SEQ ID NO: 2128 - DNA, 2672 bp, Homo sapiens
ctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttggagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaat

SEQ ID NO: 2129 - DNA, 2429 bp, Homo sapiens
tctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaat

SEQ ID NO: 2130 - DNA, 1147 bp, Homo sapiens
agaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaat

SEQ ID NO: 2131 - DNA, 2336 bp, Homo sapiens
tctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaat

SEQ ID NO: 2132 - DNA, 1874 bp, Homo sapiens
gatcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgcttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattccta

SEQ ID NO: 2133 - DNA, 567 bp, Artificial Sequence
  Synthetic oligonucleotide
gatcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgag

SEQ ID NO: 2134 - DNA, 179 bp, Artificial Sequence
  Synthetic oligonucleotide
gtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactg

SEQ ID NO: 2135 - DNA, 567 bp, Artificial Sequence
  Synthetic oligonucleotide
gtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgcttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattccta

SEQ ID NO: 2136 - DNA, 1087 bp, Artificial Sequence
  Synthetic oligonucleotide
ctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttggagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacag

SEQ ID NO: 2137 - DNA, 149 bp, Artificial Sequence
  Synthetic oligonucleotide
aaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccag

SEQ ID NO: 2138 - DNA, 371 bp, Artificial Sequence
  Synthetic oligonucleotide
actttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccag

SEQ ID NO: 2139 - DNA, 149 bp, Artificial Sequence
  Synthetic oligonucleotide
aaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagg

SEQ ID NO: 2140 - DNA, 1691 bp, Artificial Sequence
  Synthetic oligonucleotide
tctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctag

SEQ ID NO: 2141 - DNA, 165 bp, Artificial Sequence
  Synthetic oligonucleotide
gagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgag

SEQ ID NO: 2142 - DNA, 574 bp, Artificial Sequence
  Synthetic oligonucleotide
agaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcag

SEQ ID NO: 2143 - DNA, 267 bp, Artificial Sequence
  Synthetic oligonucleotide
acagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaat

SEQ ID NO: 2144 - DNA, 5 bp, Artificial Sequence
  Synthetic oligonucleotide
tttag

SEQ ID NO: 2145 - DNA, 86 bp, Artificial Sequence
  Synthetic oligonucleotide
atgcaaaatccacaagtattcaagtgattgttaaagagggaggcctgaagttgattcagatccaagacaatggcaccgggatcagg

SEQ ID NO: 2146 - DNA, 94 bp, Artificial Sequence
  Synthetic oligonucleotide
aaagaagatctggatattgtatgtgaaaggttcactactagtaaactgcagtcctttgaggatttagccagtatttctacctatggctttcgag

SEQ ID NO: 2147 - DNA, 5 bp, Artificial Sequence
  Synthetic oligonucleotide
gtgag

SEQ ID NO: 2148 - DNA, 74 bp, Artificial Sequence
  Synthetic oligonucleotide
gctttggccagcataagccatgtggctcatgttactattacaacgaaaacagctgatggaaagtgtgcatacag

SEQ ID NO: 2149 - DNA, 73 bp, Artificial Sequence
  Synthetic oligonucleotide
agcaagttactcagatggaaaactgaaagcccctcctaaaccatgtgctggcaatcaagggacccagatcacg

SEQ ID NO: 2150 - DNA, 92 bp, Artificial Sequence
  Synthetic oligonucleotide
gtggaggaccttttttacaacatagccacgaggagaaaagctttaaaaaatccaagtgaagaatatgggaaaattttggaagttgttggcag

SEQ ID NO: 2151 - DNA, 43 bp, Artificial Sequence
  Synthetic oligonucleotide
gtattcagtacacaatgcaggcattagtttctcagttaaaaaa

SEQ ID NO: 2152 - DNA, 89 bp, Artificial Sequence
  Synthetic oligonucleotide
caaggagagacagtagctgatgttaggacactacccaatgcctcaaccgtggacaatattcgctccatctttggaaatgctgttagtcg

SEQ ID NO: 2153 - DNA, 5 bp, Artificial Sequence
  Synthetic oligonucleotide
tttag

SEQ ID NO: 2154 - DNA, 109 bp, Artificial Sequence
  Synthetic oligonucleotide
ttctccgggagatgttgcataaccactccttcgtgggctgtgtgaatcctcagtgggccttggcacagcatcaaaccaagttataccttctcaacaccaccaagcttag

SEQ ID NO: 2155 - DNA, 64 bp, Artificial Sequence
  Synthetic oligonucleotide
tgaagaactgttctaccagatactcatttatgattttgccaattttggtgttctcaggttatcg

SEQ ID NO: 2156 - DNA, 93 bp, Artificial Sequence
  Synthetic oligonucleotide
gaagggaacctgattggattaccccttctgattgacaactatgtgccccctttggagggactgcctatcttcattcttcgactagccactgag

SEQ ID NO: 2157 - DNA, 114 bp, Artificial Sequence
  Synthetic oligonucleotide
gtgaattgggacgaagaaaaggaatgttttgaaagcctcagtaaagaatgcgctatgttctattccatccggaagcagtacatatctgaggagtcgaccctctcaggccagcag

SEQ ID NO: 2158 - DNA, 99 bp, Artificial Sequence
  Synthetic oligonucleotide
agtgaagtgcctggctccattccaaactcctggaagtggactgtggaacacattgtctataaagccttgcgctcacacattctgcctcctaaacatttc

SEQ ID NO: 2159 - DNA, 5652 bp, Homo sapiens
cattatttttgaactggcccccaggtcctgtctttagccctgcctcttaacattgtcttggattcaacctaggtggagtcttcattctctcatccagctcctcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatgcatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaaaagtcgcccctcagcaccctggactggacagatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgaatattcccaggattcagaagctattgaagtcaaagctgctattgcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaagtaagtccctggtcctagcaaatgccacttgcatgcactaatttcccgggaagcttgcatgctgctcgcccctctgagtgttagaaagagccttttatttcagaaagtacagtagaagcagcacttcccattgttatattgaacagcaaaatgtctctgaggcaaggaaaatgtcgtcaagtttagctactttgaagtaacactaacacaaaattcttctttgtctgtttgttcgtttctctcaaccacagacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 2160 - DNA, 2821 bp, Homo sapiens
gaggttacagtgagctaccatcacaccactgcactccagcctgggtaacagggcaaaaccctgtgtctaaaaataaaaatcaaaaaatatgaatctgcagctaaatcagactgttccaataaaaggtctttgagactaatgcaggccagagaatggcctgaagggaagttttgggtccaccctttgagaggcacctcagagtggccttacctacctgccacccttaaagggactcagtgggctaatgtagagcagtacgaaaacgttgtgaaatgaccacagaatacttatttttcatgggaaagctagattttgaaaaaagaacaccagtgttagattagcttgaagacttacaagtggttctaaacgtgtggagacgagttttctctgttatgatttctactcattggcttctctctctctcaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 2161 - DNA, 4692 bp, Homo sapiens
cattatttttgaactggcccccaggtcctgtctttagccctgcctcttaacattgtcttggattcaacctaggtggagtcttcattctctcatccagctcctcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatgcatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaaaagtcgcccctcagcaccctggactggacagatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgaatattcccaggattcagaagctattgaagtcaaagctgctattgcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaaggtaaacagatattttgcagattcaaatttactctagatgaatgagccttttaaaaggaatgaagggagttgggcatggtggcttatgcctgtaatcccaacaccttgagaggccaaggcaggaggatgacttgaagtcaggagttcaagaccagcc

SEQ ID NO: 2162 - DNA, 1280 bp, Homo sapiens
aagtacattaagctgtggagtgaacacataagcacagtcttaatcaaagtcggtttagtcatgtctggaccgatcacagcaatctccagttgtgaattttaatcgcccctgtgtgtcatcaattctgggtgagaaaattctaacttttcttttttcttttaaagcatacgatgaggcctatgctgaattccagaggttgaagtaagtccctggtcctagcaaatgccacttgcatgcactaatttcccgggaagcttgcatgctgctcgcccctctgagtgttagaaagagccttttatttcagaaagtacagtagaagcagcacttcccattgttatattgaacagcaaaatgtctctgaggcaaggaaaatgtcgtcaagtttagctactttgaagtaacactaacacaaaattcttctttgtctgtttgttcgtttctctcaaccacagacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 2163 - DNA, 1722 bp, Homo sapiens
cattatttttgaactggcccccaggtcctgtctttagccctgcctcttaacattgtcttggattcaacctaggtggagtcttcattctctcatccagctcctcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtatgttatctttatgaaagctaacagaattcattacaccaagttaagttcgcctctagtggaaacacacagaacaaccatatgcaagagtcaatgaagacatctacaagattgtataggtttttaaaagagtgaagaagggtaggcattgagatgaatttgtatgcatgggaagaaaaaacagtcttgcatatatacgctacatgataatactctataatcctattatacaaatggatctttattttatatgaagtattgcattttagtcaacatatgtaccaacataccaaatatatgtctataactcttacggatgataaaagttaggtaaaaatcagcttccagcaatgaactttacacaacatggcaggattttgtgatcagaagcaatgctgccttttacaaaactccctttaactaaaactcccatctctacccctcatgtgagctgaggcctcaatgtgcctttcttcctttctttctttctttttttctttcttctttcttttctttttctttctttctctcttttccttttttctttctttttctttatcttcctctttctttccttccttctttctctttctttctttctctctctcccttccttc

SEQ ID NO: 2164 - DNA, 148 bp, Artificial Sequence
  Synthetic oligonucleotide
cattatttttgaactggcccccaggtcctgtctttagccctgcctcttaacattgtcttggattcaacctaggtggagtcttcattctctcatccagctcctcggcctcatcggaacatttccaccaccattactcctttggaaactg

SEQ ID NO: 2165 - DNA, 318 bp, Artificial Sequence
  Synthetic oligonucleotide
gtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatgg

SEQ ID NO: 2166 - DNA, 141 bp, Artificial Sequence
  Synthetic oligonucleotide
acttacagattccagtctgctgttagatgattattcatccaagttgagccccaaaccaaagagagccaagcacagcctactgtctggagaagagaaagaaaatttgcccagtgactacatggtacccattttctcaggacg

SEQ ID NO: 2167 - DNA, 340 bp, Artificial Sequence
  Synthetic oligonucleotide
tcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaaca

SEQ ID NO: 2168 - DNA, 158 bp, Artificial Sequence
  Synthetic oligonucleotide
ttagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtg

SEQ ID NO: 2169 - DNA, 617 bp, Artificial Sequence
  Synthetic oligonucleotide
gtatgttatctttatgaaagctaacagaattcattacaccaagttaagttcgcctctagtggaaacacacagaacaaccatatgcaagagtcaatgaagacatctacaagattgtataggtttttaaaagagtgaagaagggtaggcattgagatgaatttgtatgcatgggaagaaaaaacagtcttgcatatatacgctacatgataatactctataatcctattatacaaatggatctttattttatatgaagtattgcattttagtcaacatatgtaccaacataccaaatatatgtctataactcttacggatgataaaagttaggtaaaaatcagcttccagcaatgaactttacacaacatggcaggattttgtgatcagaagcaatgctgccttttacaaaactccctttaactaaaactcccatctctacccctcatgtgagctgaggcctcaatgtgcctttcttcctttctttctttctttttttctttcttctttcttttctttttctttctttctctcttttccttttttctttctttttctttatcttcctctttctttccttccttctttctctttctttctttctctctctcccttccttc

SEQ ID NO: 2170 - DNA, 165 bp, Artificial Sequence
  Synthetic oligonucleotide
ttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacg

SEQ ID NO: 2171 - DNA, 162 bp, Artificial Sequence
  Synthetic oligonucleotide
gagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgag

SEQ ID NO: 2172 - DNA, 142 bp, Artificial Sequence
  Synthetic oligonucleotide
atgctgatgcagagattgaaggagccccagctgctcccttggatgtgaagtgcttggaggccaacaaagattatatcatcatctcctggaaacagccagctgtcgatggagggagtcctattctcggatattttattgataa

SEQ ID NO: 2173 - DNA, 141 bp, Artificial Sequence
  Synthetic oligonucleotide
gttttcctgtcactggattgatcgaaggtcgttcctatatcttccgagttcgagctgtgaataaaatgggaataggtttcccatctcgagtttccgagcccgtggctgctctggatccggctgagaaagctagacttaaaa

SEQ ID NO: 2174 - DNA, 125 bp, Artificial Sequence
  Synthetic oligonucleotide
agggtattgtgcctggccccccgacagacctctctgtcactgaggccacccggagctatgtggtgctcagctggaagccccctggccagcgtggtcatgagggcattatgtactttgtggaaaag

SEQ ID NO: 2175 - DNA, 184 bp, Artificial Sequence
  Synthetic oligonucleotide
tgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttg

SEQ ID NO: 2176 - DNA, 175 bp, Artificial Sequence
  Synthetic oligonucleotide
atatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacg

SEQ ID NO: 2177 - DNA, 122 bp, Artificial Sequence
  Synthetic oligonucleotide
attcacttgtcatggattagtgactggtcagagttatattttccgggtcagagcagtcaatgcagctggacttagtgaatattcccaggattcagaagctattgaagtcaaagctgctattg

SEQ ID NO: 2178 - DNA, 197 bp, Artificial Sequence
  Synthetic oligonucleotide
caccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaag

SEQ ID NO: 2179 - DNA, 127 bp, Artificial Sequence
  Synthetic oligonucleotide
attagcaacttgaaggaaaacatggtgtatcagttccaagtggcagccatgaacatggctgggctgggcgcgccctccgcagtaagcgaatgcttcaaatgtgaagagtggaccatcgccgtcccag

SEQ ID NO: 2180 - DNA, 426 bp, Artificial Sequence
  Synthetic oligonucleotide
gaggttacagtgagctaccatcacaccactgcactccagcctgggtaacagggcaaaaccctgtgtctaaaaataaaaatcaaaaaatatgaatctgcagctaaatcagactgttccaataaaaggtctttgagactaatgcaggccagagaatggcctgaagggaagttttgggtccaccctttgagaggcacctcagagtggccttacctacctgccacccttaaagggactcagtgggctaatgtagagcagtacgaaaacgttgtgaaatgaccacagaatacttatttttcatgggaaagctagattttgaaaaaagaacaccagtgttagattagcttgaagacttacaagtggttctaaacgtgtggagacgagttttctctgttatgatttctactcattggcttctctctctctcag

SEQ ID NO: 2181 - DNA, 185 bp, Artificial Sequence
  Synthetic oligonucleotide
gaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaag

SEQ ID NO: 2182 - DNA, 157 bp, Artificial Sequence
  Synthetic oligonucleotide
gaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaa

SEQ ID NO: 2183 - DNA, 137 bp, Artificial Sequence
  Synthetic oligonucleotide
ctgtcccagttaaatcagagttggcagttgaaattttggagaaaggccaggtccggttttggatgcaggctgagaaactgtctggcaatgccaaagtcaactacatatttaacgagaaggaaatttttgaaggcccg

SEQ ID NO: 2184 - DNA, 145 bp, Artificial Sequence
  Synthetic oligonucleotide
aaatataaaatgcatattgaccgaaacactggcatcatcgaaatgttcatggaaaagctacaggatgaggatgagggaacgtacactttccagcttcaagatggaaaagcaactaaccattctactgttgttctcgttggagatg

SEQ ID NO: 2185 - DNA, 164 bp, Artificial Sequence
  Synthetic oligonucleotide
tgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaag

SEQ ID NO: 2186 - DNA, 156 bp, Artificial Sequence
  Synthetic oligonucleotide
gtaaacagatattttgcagattcaaatttactctagatgaatgagccttttaaaaggaatgaagggagttgggcatggtggcttatgcctgtaatcccaacaccttgagaggccaaggcaggaggatgacttgaagtcaggagttcaagaccagcc

SEQ ID NO: 2187 - DNA, 164 bp, Artificial Sequence
  Synthetic oligonucleotide
aagtacattaagctgtggagtgaacacataagcacagtcttaatcaaagtcggtttagtcatgtctggaccgatcacagcaatctccagttgtgaattttaatcgcccctgtgtgtcatcaattctgggtgagaaaattctaacttttcttttttcttttaaag

SEQ ID NO: 2188 - DNA, 251 bp, Artificial Sequence
  Synthetic oligonucleotide
gtaagtccctggtcctagcaaatgccacttgcatgcactaatttcccgggaagcttgcatgctgctcgcccctctgagtgttagaaagagccttttatttcagaaagtacagtagaagcagcacttcccattgttatattgaacagcaaaatgtctctgaggcaaggaaaatgtcgtcaagtttagctactttgaagtaacactaacacaaaattcttctttgtctgtttgttcgtttctctcaaccacag

SEQ ID NO: 2189 - DNA, 749 bp, Artificial Sequence
  Synthetic oligonucleotide
gcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 2190 - DNA, 93 bp, Artificial Sequence
  Synthetic oligonucleotide
gtataaaaaccaggtgccaataaatgtccatgcaaaccctggaaagtatattattgagagtcgatatgggatgcacactctggagattaatgc

SEQ ID NO: 2191 - DNA, 89 bp, Artificial Sequence
  Synthetic oligonucleotide
atgtgattttgaagatacagctcagtaccgggcctcggcgatgaatgttaaaggagagctttcggcatatgcttcagttgtggtaaaaa

SEQ ID NO: 2192 - DNA, 63 bp, Artificial Sequence
  Synthetic oligonucleotide
ggtataagggagagtttgatgagactcgcttccacgctggggcttccaccatgcccctcagct

SEQ ID NO: 2193 - DNA, 46 bp, Artificial Sequence
  Synthetic oligonucleotide
gtgtgaggtgggcacagatagctggtcgcagtgcaatgacacacct

SEQ ID NO: 2194 - DNA, 13 bp, Artificial Sequence
  Synthetic oligonucleotide
gtgaagtttgctc

SEQ ID NO: 2195 - DNA, 57 bp, Artificial Sequence
  Synthetic oligonucleotide
gtcgcccctcagcaccctggactggacagatcattgttactgaagaggaaccttcag

SEQ ID NO: 2196 - DNA, 115 bp, Artificial Sequence
  Synthetic oligonucleotide
gttcgaggcctcaaggagggcgtcagctacgtgttccgtgttcgagccataaaccaggcgggagttgggaagccatctgaccttgctggccctgttgtggcagagacccgtccag

SEQ ID NO: 2197 - DNA, 107 bp, Artificial Sequence
  Synthetic oligonucleotide
gacgaaaatgaccttcaaagaccttgggatggatgacttgggtatttactcttgcgatgtaacagacactgatggaatagcatcaagctacttaatagatgaggaag

SEQ ID NO: 2198 - DNA, 45 bp, Artificial Sequence
  Synthetic oligonucleotide
aattgaaacgtttacttgctctcagccatgaacacaagttcccaa

SEQ ID NO: 2199 - DNA, 60 bp, Artificial Sequence
  Synthetic oligonucleotide
ttttcaaaaagctccagaaagaagctgaattccagcggcaagaatggatcaggaaacaag

SEQ ID NO: 2200 - DNA, 68 bp, Artificial Sequence
  Synthetic oligonucleotide
gtcctcactttgttgagtatttgagctgggaagtgactggtgaatgtaatgtactattgaaatgcaag

SEQ ID NO: 2201 - DNA, 114 bp, Artificial Sequence
  Synthetic oligonucleotide
gtggcaaatattaagaaggagactcatattgtgtggtacaaagatgagagggagatatcagtggatgaaaagcatgactttaaggatggtatatgtaccctgcttataacagag

SEQ ID NO: 2202 - DNA, 88 bp, Artificial Sequence
  Synthetic oligonucleotide
ttttccaagaaagatgctgggatttatgaagttatcctgaaagatgaccgaggaaaagataagagcagactgaagcttgtggatgaag

SEQ ID NO: 2203 - DNA, 39 bp, Artificial Sequence
  Synthetic oligonucleotide
cctttaaggaactgatgatggaagtatgcaaaaaaatag

SEQ ID NO: 2204 - DNA, 106 bp, Artificial Sequence
  Synthetic oligonucleotide
ctttgtctgctacagacctgaaaatccagagcacagccgagggcatccaactgtactcttttgtaacttactatgtggaggatttgaaagttaactggtcccacaa

SEQ ID NO: 2205 - DNA, 37 bp, Artificial Sequence
  Synthetic oligonucleotide
catacgatgaggcctatgctgaattccagaggttgaa

SEQ ID NO: 2206 - DNA, 23 bp, Artificial Sequence
  Synthetic oligonucleotide
acaagctgccattgccgagaaaa

SEQ ID NO: 2207 - DNA, 56 bp, Artificial Sequence
  Synthetic oligonucleotide
atcgtgcccgggtgttgggaggtctcccagacgtggtcaccatccaggaggggaag

SEQ ID NO: 2208 - DNA, 3484 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagagacagggatttgctgtgtttcccaggctggtcttgaactcctggcctcaagggatcccttctgcttcagcttcctaaagtactgggattacaggtgtgagccaccgcgcctagcctccctattcattcttatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2209 - DNA, 3546 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagatatgccagttcctcctggactcctcagactggaagattgtcctttctccttggcaaaccatctgtactatctgattgcatcttacagtcttctttaaatattattgttccttaactgttaatgtgtctgtgccttgaggtcagcctcaggttccaatcctgttccattttgtttgtggaatctcaggcaagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2210 - DNA, 3475 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagctcctgggccatgatcccattttcatcagatgacttgagaacccagaagctctaccagcactgccattctgtcccgtcttgaaacatcatgccctggttgccctctcctggaatagggcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2211 - DNA, 3648 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtattatcccagggctagtttcccccacgatggcggaatggccacagcagtttcaggcttcacatttgggcacagcctccgtcacaccagcctgaccaagagaatatgccagttcctcctggactcctcagactggaagattgtcctttctccttggcaaaccatctgtactatctgattgcatcttacagtcttctttaaatattattgttccttaactgttaatgtgtctgtgccttgaggtcagcctcaggttccaatcctgttccattttgtttgtggaatctcaggcaagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2212 - DNA, 2264 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2213 - DNA, 2444 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagatatgccagttcctcctggactcctcagactggaagattgtcctttctccttggcaaaccatctgtactatctgattgcatcttacagtcttctttaaatattattgttccttaactgttaatgtgtctgtgccttgaggtcagcctcaggttccaatcctgttccattttgtttgtggaatctcaggcaagtatatttttggagattttagccctgatgaattcaatcaattctttgtgactcctcgatcttcagttgagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2214 - DNA, 1644 bp, Homo sapiens
ctttataggaggaaaatgccattaaaaatcctctatttaccttgggatttcctctattttattagaacaggctatgatacttggagaaaatggaaagcagcagcgttttgaggccatggcagggtggctgcctttatgaaccggtgcagtaaataacagtgtggagaggaagtgaaagaatttggaaaatgaaatatgttttcttccagagcactggcgttgggaacatttatcaactggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2215 - DNA, 121 bp, Artificial Sequence
  Synthetic oligonucleotide
ctcctgggccatgatcccattttcatcagatgacttgagaacccagaagctctaccagcactgccattctgtcccgtcttgaaacatcatgccctggttgccctctcctggaatagggcag

SEQ ID NO: 2216 - DNA, 130 bp, Artificial Sequence
  Synthetic oligonucleotide
agacagggatttgctgtgtttcccaggctggtcttgaactcctggcctcaagggatcccttctgcttcagcttcctaaagtactgggattacaggtgtgagccaccgcgcctagcctccctattcattct

SEQ ID NO: 2217 - DNA, 192 bp, Artificial Sequence
  Synthetic oligonucleotide
atatgccagttcctcctggactcctcagactggaagattgtcctttctccttggcaaaccatctgtactatctgattgcatcttacagtcttctttaaatattattgttccttaactgttaatgtgtctgtgccttgaggtcagcctcaggttccaatcctgttccattttgtttgtggaatctcaggcaag

SEQ ID NO: 2218 - DNA, 377 bp, Artificial Sequence
  Synthetic oligonucleotide
gacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctg

SEQ ID NO: 2219 - DNA, 503 bp, Artificial Sequence
  Synthetic oligonucleotide
gtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccag

SEQ ID NO: 2220 - DNA, 178 bp, Artificial Sequence
  Synthetic oligonucleotide
aacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcag

SEQ ID NO: 2221 - DNA, 239 bp, Artificial Sequence
  Synthetic oligonucleotide
ctttataggaggaaaatgccattaaaaatcctctatttaccttgggatttcctctattttattagaacaggctatgatacttggagaaaatggaaagcagcagcgttttgaggccatggcagggtggctgcctttatgaaccggtgcagtaaataacagtgtggagaggaagtgaaagaatttggaaaatgaaatatgttttcttccagagcactggcgttgggaacatttatcaactg

SEQ ID NO: 2222 - DNA, 120 bp, Artificial Sequence
  Synthetic oligonucleotide
ccatttttcacgttgcagttggatatccagtcagacaagatacgcacagtccaggatgcactggagagcttggtggcaagagaatctgtccaaggttataccacaaaaaccaaacaagag

SEQ ID NO: 2223 - DNA, 595 bp, Artificial Sequence
  Synthetic oligonucleotide
ctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaat

SEQ ID NO: 2224 - DNA, 196 bp, Artificial Sequence
  Synthetic oligonucleotide
atttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 2225 - DNA, 81 bp, Artificial Sequence
  Synthetic oligonucleotide
cagtgcgcaggcgcggcggccgatgcgagtgtgtatgtgcgggcgagaagatggcggcggcgggggaagcagcgtgagcag

SEQ ID NO: 2226 - DNA, 34 bp, Artificial Sequence
  Synthetic oligonucleotide
ccggaggatcgcggagtcccaatgaaacgggcag

SEQ ID NO: 2227 - DNA, 8 bp, Artificial Sequence
  Synthetic oligonucleotide
ccatggcc

SEQ ID NO: 2228 - DNA, 15 bp, Artificial Sequence
  Synthetic oligonucleotide
ctccacagcccgcag

SEQ ID NO: 2229 - DNA, 102 bp, Artificial Sequence
  Synthetic oligonucleotide
tattatcccagggctagtttcccccacgatggcggaatggccacagcagtttcaggcttcacatttgggcacagcctccgtcacaccagcctgaccaagaga

SEQ ID NO: 2230 - DNA, 22 bp, Artificial Sequence
  Synthetic oligonucleotide
tatatttttggagattttagcc

SEQ ID NO: 2231 - DNA, 12 bp, Artificial Sequence
  Synthetic oligonucleotide
ctgatgaattca

SEQ ID NO: 2232 - DNA, 35 bp, Artificial Sequence
  Synthetic oligonucleotide
atcaattctttgtgactcctcgatcttcagttgag

SEQ ID NO: 2233 - DNA, 61 bp, Artificial Sequence
  Synthetic oligonucleotide
cttcctccatacagtggaacagttctgtgtggcacacaggctgtggataaactacctgatg

SEQ ID NO: 2234 - DNA, 65 bp, Artificial Sequence
  Synthetic oligonucleotide
cctctttcatgattctaagccctcttcctcctcgccggtggcctatgtggaaactaagtattccc

SEQ ID NO: 2235 - DNA, 96 bp, Artificial Sequence
  Synthetic oligonucleotide
ctcccgccatatctcccctggtttctgaaaagcaggttgaagtcaaagaagggcttgttccggtttcagaggatcctgtagccataaagattgcag

SEQ ID NO: 2236 - DNA, 92 bp, Artificial Sequence
  Synthetic oligonucleotide
agttgctggagaatgtaaccctaatccataaaccagtgtcgttgcaaccccgtgggctgatcaataaagggaactggtgctacattaatgct

SEQ ID NO: 2237 - DNA, 110 bp, Artificial Sequence
  Synthetic oligonucleotide
acactgcaggcattggttgcttgcccgccgatgtaccacctgatgaagttcattcctctgtattccaaagtgcaaaggccttgtacgtcaacacccatgatagacagctt

SEQ ID NO: 2238 - DNA, 56 bp, Artificial Sequence
  Synthetic oligonucleotide
tgttcggctaatgaatgagttcactaatatgccagtacctccaaaaccccgacaag

SEQ ID NO: 2239 - DNA, 104 bp, Artificial Sequence
  Synthetic oligonucleotide
ctcttggagataaaatcgtgagggatattcgccctggagctgcctttgagcccacatatatttacagactcctgacagttaacaagtcaagcctgtctgaaaag

SEQ ID NO: 2240 - DNA, 91 bp, Artificial Sequence
  Synthetic oligonucleotide
ggtcgacaagaagatgctgaggaatacttaggcttcattctaaatggacttcatgaggaaatgttgaacctaaagaagcttctctcaccaa

SEQ ID NO: 2241 - DNA, 9 bp, Artificial Sequence
  Synthetic oligonucleotide
gtaatgaaa

SEQ ID NO: 2242 - DNA, 46 bp, Artificial Sequence
  Synthetic oligonucleotide
gtctgtggtttaccagcagagttcaaaagaatctgccactttgcag

SEQ ID NO: 2243 - DNA, 62 bp, Artificial Sequence
  Synthetic oligonucleotide
gttgagataagtcgaagagtgactctggaaaaactccctcctgtcctcgtgctgcacctgaa

SEQ ID NO: 2244 - DNA, 83 bp, Artificial Sequence
  Synthetic oligonucleotide
acgattcgtttatgagaagactggtgggtgccagaagcttatcaaaaatattgaatatcctgtggacttggaaattagtaaag

SEQ ID NO: 2245 - DNA, 66 bp, Artificial Sequence
  Synthetic oligonucleotide
aactgctttctccaggggttaaaaataagaattttaaatgccaccgaacctatcggctctttgcag

SEQ ID NO: 2246 - DNA, 76 bp, Artificial Sequence
  Synthetic oligonucleotide
tggtctaccatcacggcaacagtgcgacgggcggccattacactacagacgtcttccagatcggtctgaatggctg

SEQ ID NO: 2247 - DNA, 115 bp, Artificial Sequence
  Synthetic oligonucleotide
gctgcgcatcgatgaccagacagtcaaggtgatcaaccagtaccaggtggtgaaaccaactgctgaacgcacagcctacctcctgtattaccgccgagtggacctgctgtaaacc

SEQ ID NO: 2248 - DNA, 29 bp, Artificial Sequence
  Synthetic oligonucleotide
gttagtctacatagatgggtgattgtaac

SEQ ID NO: 2249 - DNA, 17 bp, Artificial Sequence
  Synthetic oligonucleotide
tttattgccattaaaag

SEQ ID NO: 2250 - DNA, 3224 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2251 - DNA, 3376 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcaggaaaattaagacttggatttactattctacctcagcccttcttgtatattgaaaataaaactaccaactcttcagttaccggaggaaaaagaacttctctgatatcatccctcagcactgatgttctcatgggagcagtgccgtgtctgcatggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2252 - DNA, 2752 bp, Homo sapiens
tgaggtggcgtctcgcactgtcacccaggttggagtgcaatggcgtgatcttagctcattgcaacgtccgcctcctgggttcaagcgattctcctgcctcattccccaagtagctgggatttcaggtacccgccaccacgcccagctaatttttgtatttttagtagaggcagggtttcatcatgttggccaggctggtctcatactcctgaccttaggtgatctgcccgcctcggcctcccaaagtgctgggattacaggggtgagccaccgcgcccagtcagaattttctagatctggattttgctgagtgcatctcctgatgtagtttaacatgttcttctctcctatttatttttctataaattggtggttggatccagaagcatgatcaggttgagggtcagtttgtcttggtttttgtgtttggtaaacctcaaccatttgctctttctttgaaagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2253 - DNA, 3512 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagcttcctgcctcagtctctgggtatttgcggggggcgggtttggtctgaatgcagctgacatgtcagactcaccactggctgctgctggagaggtagcaatagtggttcccctgcacccgggccacctcagatgctggtacttacttaaccaagggatttggcctggcactgccccctgccagtgctgcagcgtgccatccgcaaggcaggcctgccaacgctgcttcccaggccagcagggccctaaagcttggcagaaacttcaagccagaaagaaaccacgccag

SEQ ID NO: 2254 - DNA, 3080 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2255 - DNA, 2608 bp, Homo sapiens
tgaggtggcgtctcgcactgtcacccaggttggagtgcaatggcgtgatcttagctcattgcaacgtccgcctcctgggttcaagcgattctcctgcctcattccccaagtagctgggatttcaggtacccgccaccacgcccagctaatttttgtatttttagtagaggcagggtttcatcatgttggccaggctggtctcatactcctgaccttaggtgatctgcccgcctcggcctcccaaagtgctgggattacaggggtgagccaccgcgcccagtcagaattttctagatctggattttgctgagtgcatctcctgatgtagtttaacatgttcttctctcctatttatttttctataaattggtggttggatccagaagcatgatcaggttgagggtcagtttgtcttggtttttgtgtttggtaaacctcaaccatttgctctttctttgaaagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2256 - DNA, 3333 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2257 - DNA, 4172 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggtaaactggagcctgagatccagggcgagaggagactccaggaggaatctctgaacccaggcagagtgtaaggagagtttgccactggagggttccatgtgactgggtgaacagcacatcccagtcttcacctggcaagatccagagctcatgtcccctagtccttggggaagaatgcttaaggatgcttttgagcgacagtgcccaggctgctgctgtctggagatgtagtgatctccagacttggaatggggccccctttcagctggttgtctgggctttaagctggaaagaaacaactggttaacatggaggcccaggaagctcagtataattgcatgaaaattcacagcgggatgcggctcagcaaccctcctgcagccagcagctgctacccttccccttctcaagggccagcctccattttccaaagagcactgtgctggcacaggccctggggaagaggagtcagtgggtccctctctagacccactgttttcagggtccagcatggctcccccactggactgggctgtggctggctgggttttgttcgtgaggttgaggtagcacagttttaggatatgggtataaacattaatatttctccccaagaattctcatccagacagatgaaaagccgtctgtggctttacaaggtaagccccccgtggagggcaggttgttggtgaccattcctcccagggccccatggggctggcagccagaacactggccccaccgcagggtgcccgtccctggctccttggctcctgcatggcagccagctggccgcgccctggctgaccgctgctctctctcttctctcccggctacagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2258 - DNA, 4327 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggtaaactggagcctgagatccagggcgagaggagactccaggaggaatctctgaacccaggcagagtgtaaggagagtttgccactggagggttccatgtgactgggtgaacagcacatcccagtcttcacctggcaagatccagagctcatgtcccctagtccttggggaagaatgcttaaggatgcttttgagcgacagtgcccaggctgctgctgtctggagatgtagtgatctccagacttggaatggggccccctttcagctggttgtctgggctttaagctggaaagaaacaactggttaacatggaggcccaggaagctcagtataattgcatgaaaattcacagcgggatgcggctcagcaaccctcctgcagccagcagctgctacccttccccttctcaagggccagcctccattttccaaagagcactgtgctggcacaggccctggggaagaggagtcagtgggtccctctctagacccactgttttcagggtccagcatggctcccccactggactgggctgtggctggctgggttttgttcgtgaggttgaggtagcacagttttaggatatgggtataaacattaatatttctccccaagaattctcatccagacagatgaaaagccgtctgtggctttacaaggtaagccccccgtggagggcaggttgttggtgaccattcctcccagggccccatggggctggcagccagaacactggccccaccgcagggtgcccgtccctggctccttggctcctgcatggcagccagctggccgcgccctggctgaccgctgctctctctcttctctcccggctacagtttgcttcctcagggctttttactatctggctcctttggtttctgatctagtggcctttctcagttcccgtatcaacagctttagttgtacacccctcctgcctttgagatggctgttccatccactgagggaccagcaggcctggaatgatgagcagcgtgtgtctgggaaactctaaagggcgacctggacagacctgattgcttaaagttaaaaaaatgaagttttcagtgtgccaaacaaaacattggcagctttgaaaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2259 - DNA, 3189 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2260 - DNA, 3379 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagatggctgttccatccactgagggaccagcaggcctggaatgatgagcagcgtgtgtctgggaaactctaaagggcgacctggacagacctgattgcttaaagttaaaaaaatgaagttttcagtgtgccaaacaaaacattggcagctttgaaaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2261 - DNA, 4028 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggtaaactggagcctgagatccagggcgagaggagactccaggaggaatctctgaacccaggcagagtgtaaggagagtttgccactggagggttccatgtgactgggtgaacagcacatcccagtcttcacctggcaagatccagagctcatgtcccctagtccttggggaagaatgcttaaggatgcttttgagcgacagtgcccaggctgctgctgtctggagatgtagtgatctccagacttggaatggggccccctttcagctggttgtctgggctttaagctggaaagaaacaactggttaacatggaggcccaggaagctcagtataattgcatgaaaattcacagcgggatgcggctcagcaaccctcctgcagccagcagctgctacccttccccttctcaagggccagcctccattttccaaagagcactgtgctggcacaggccctggggaagaggagtcagtgggtccctctctagacccactgttttcagggtccagcatggctcccccactggactgggctgtggctggctgggttttgttcgtgaggttgaggtagcacagttttaggatatgggtataaacattaatatttctccccaagaattctcatccagacagatgaaaagccgtctgtggctttacaaggtaagccccccgtggagggcaggttgttggtgaccattcctcccagggccccatggggctggcagccagaacactggccccaccgcagggtgcccgtccctggctccttggctcctgcatggcagccagctggccgcgccctggctgaccgctgctctctctcttctctcccggctacagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2262 - DNA, 2717 bp, Homo sapiens
tgaggtggcgtctcgcactgtcacccaggttggagtgcaatggcgtgatcttagctcattgcaacgtccgcctcctgggttcaagcgattctcctgcctcattccccaagtagctgggatttcaggtacccgccaccacgcccagctaatttttgtatttttagtagaggcagggtttcatcatgttggccaggctggtctcatactcctgaccttaggtgatctgcccgcctcggcctcccaaagtgctgggattacaggggtgagccaccgcgcccagtcagaattttctagatctggattttgctgagtgcatctcctgatgtagtttaacatgttcttctctcctatttatttttctataaattggtggttggatccagaagcatgatcaggttgagggtcagtttgtcttggtttttgtgtttggtaaacctcaaccatttgctctttctttgaaagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2263 - DNA, 2883 bp, Homo sapiens
gagaagaccaggaatgagctgagtctgaaagacagggttgagagaatagggaggctggagagcaggccctgagccagagcgcgtgaggggtccacactcactgctaccccacgatgactcaggaaggcccctttgtttcatgctgaaacctgcagagatattagaatgacacccatgggtgggagggaggaggagtggacaagctgctcagatggaggggcccagccagcccaacttcatgccctcatctcgtcagtggctgctcggaaccaaagaggtcatctgccctggccacagggagcctgccctgaacacaggcctcacctgtcctgtgctcggacaccacaggctgactcactcaggggtttagccagaaaagcttggggtcttaccaggatgccgcagagcctgccaggttcaagtcatgaaggaatcgagcagacacatgttacatttactgatgatgctaattacacaggctgctcatatttctaaagcaggagttttcaaactttgttagtggcagaacttttgtcaaatggagtcttacccagagtcagaatctagccaccaaaatgggaagggagtggagctgccctgtccacaggcttctctatgggaaaggctgctgttctgtaaaacatggtggggcgggctgtggggaggaaggcattttctggaccacatgaacgaattcgagttgggggacggtcctaccccagtgaggaagctgaaagaaatgggcctgatttggtgcaggacagcccctgaagaccgtgaggccctggcctctgccgcagatgggagcctcagcagcagggtctagggcagcacccagggcatccttgccacgtgaggctgccgttggtgcctgggcatcagtagctcaggctggaataattggaaaggaaaaggcaggaggagcccctgaggccaggccattgggctggggagctgttaagctgaggtggccctagggcctgccggggctgggggtggcaagccaaaccggaggcaccagccaggcccacaggacacaggaggcagagccgtgaggcctggtcagagcaggtggagtgctagtgtggagactgcagggagagaccacccgagccatcagctgaggactgtggcggcccagcaggagtaacactgttgaggagaacccagcccaagcctgaggaggctggaggtgccatacggctcctgcgtgcgcctggtgtcttgcccacgctcaccgctttcttggtcagggcagtcccggctgcagcctctcactcatcacattctcatctctcatctgtctgatgttcccacctccctgtccagccccagggttaggtgagagcagctactcagtcctggccactgtcccctcccctctgcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2264 - DNA, 952 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggtgagtcacaaattaagaatttaagatgtaaaatactaaaagttgaaataggctgggcatggaggcttatgcctgtgacgccagcatttcgggaggccaaggtgggagaagcacttcggaccaatctgggcaacacagggagacctcatctctacaaacgttttttaaaaattagccaggcatggtggcacctgcctgtggtcccagctacttgggaggctgaggtggggggatcgcttgagcccaggaggtcaaggctgcagtgagctgtgatcagtcatg

SEQ ID NO: 2265 - DNA, 831 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggtggtgtcatggaagtattaaccaaagtcaaggctgtaaaatcatttcaaggaaggaggttgaggctaaatagatggaaatctaatttaaatacagaacataccttttaaacaaatgcaggaatgttattaatgccctggtctataaatccatctatttta

SEQ ID NO: 2266 - DNA, 753 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagacaagatctcactctatcccccaggctgcagtggagtggctgatcatggcttactgcaccctcaagtgaccctcccactcagcctcctgagtagctgggactacaggcgcctactacacacctggctaattttgtaaaaatgtttcgtagagatggggtctcactatgttgccaaggctggtctcaaactacggggctcaagcagtcctcctgccctggccttccaaagtggtgggattacaggagtgaaccattgagcctggcctgtattttcaattaaatcaaacacttgggagtat

SEQ ID NO: 2267 - DNA, 263 bp, Artificial Sequence
  Synthetic oligonucleotide
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagc

SEQ ID NO: 2268 - DNA, 135 bp, Artificial Sequence
  Synthetic oligonucleotide
ctgctgtcggtgatccgacagaaggagaaggatctggtgttggcggcccggctgggtaaggcgctgctcgagaggaaccaggacatgagccggcagtacgagcagatgcataaggagctgacagacaagctcgag

SEQ ID NO: 2269 - DNA, 299 bp, Artificial Sequence
  Synthetic oligonucleotide
acaagatctcactctatcccccaggctgcagtggagtggctgatcatggcttactgcaccctcaagtgaccctcccactcagcctcctgagtagctgggactacaggcgcctactacacacctggctaattttgtaaaaatgtttcgtagagatggggtctcactatgttgccaaggctggtctcaaactacggggctcaagcagtcctcctgccctggccttccaaagtggtgggattacaggagtgaaccattgagcctggcctgtattttcaattaaatcaaacacttgggagtat

SEQ ID NO: 2270 - DNA, 282 bp, Artificial Sequence
  Synthetic oligonucleotide
gtgagtcacaaattaagaatttaagatgtaaaatactaaaagttgaaataggctgggcatggaggcttatgcctgtgacgccagcatttcgggaggccaaggtgggagaagcacttcggaccaatctgggcaacacagggagacctcatctctacaaacgttttttaaaaattagccaggcatggtggcacctgcctgtggtcccagctacttgggaggctgaggtggggggatcgcttgagcccaggaggtcaaggctgcagtgagctgtgatcagtcatg

SEQ ID NO: 2271 - DNA, 161 bp, Artificial Sequence
  Synthetic oligonucleotide
gtggtgtcatggaagtattaaccaaagtcaaggctgtaaaatcatttcaaggaaggaggttgaggctaaatagatggaaatctaatttaaatacagaacataccttttaaacaaatgcaggaatgttattaatgccctggtctataaatccatctatttta

SEQ ID NO: 2272 - DNA, 152 bp, Artificial Sequence
  Synthetic oligonucleotide
aaaattaagacttggatttactattctacctcagcccttcttgtatattgaaaataaaactaccaactcttcagttaccggaggaaaaagaacttctctgatatcatccctcagcactgatgttctcatgggagcagtgccgtgtctgcatg

SEQ ID NO: 2273 - DNA, 147 bp, Artificial Sequence
  Synthetic oligonucleotide
atcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacag

SEQ ID NO: 2274 - DNA, 462 bp, Artificial Sequence
  Synthetic oligonucleotide
tgaggtggcgtctcgcactgtcacccaggttggagtgcaatggcgtgatcttagctcattgcaacgtccgcctcctgggttcaagcgattctcctgcctcattccccaagtagctgggatttcaggtacccgccaccacgcccagctaatttttgtatttttagtagaggcagggtttcatcatgttggccaggctggtctcatactcctgaccttaggtgatctgcccgcctcggcctcccaaagtgctgggattacaggggtgagccaccgcgcccagtcagaattttctagatctggattttgctgagtgcatctcctgatgtagtttaacatgttcttctctcctatttatttttctataaattggtggttggatccagaagcatgatcaggttgagggtcagtttgtcttggtttttgtgtttggtaaacctcaaccatttgctctttctttgaaag

SEQ ID NO: 2275 - DNA, 180 bp, Artificial Sequence
  Synthetic oligonucleotide
ctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcag

SEQ ID NO: 2276 - DNA, 121 bp, Artificial Sequence
  Synthetic oligonucleotide
gaagaatgctgtggagctggaacttgccaagtgcaggatggatatgatgtctctgaacagccagttgctggatgccattcagcagaaactgaacctctcgcagcagctggaagcttggcag

SEQ ID NO: 2277 - DNA, 839 bp, Artificial Sequence
  Synthetic oligonucleotide
gtaaactggagcctgagatccagggcgagaggagactccaggaggaatctctgaacccaggcagagtgtaaggagagtttgccactggagggttccatgtgactgggtgaacagcacatcccagtcttcacctggcaagatccagagctcatgtcccctagtccttggggaagaatgcttaaggatgcttttgagcgacagtgcccaggctgctgctgtctggagatgtagtgatctccagacttggaatggggccccctttcagctggttgtctgggctttaagctggaaagaaacaactggttaacatggaggcccaggaagctcagtataattgcatgaaaattcacagcgggatgcggctcagcaaccctcctgcagccagcagctgctacccttccccttctcaagggccagcctccattttccaaagagcactgtgctggcacaggccctggggaagaggagtcagtgggtccctctctagacccactgttttcagggtccagcatggctcccccactggactgggctgtggctggctgggttttgttcgtgaggttgaggtagcacagttttaggatatgggtataaacattaatatttctccccaagaattctcatccagacagatgaaaagccgtctgtggctttacaaggtaagccccccgtggagggcaggttgttggtgaccattcctcccagggccccatggggctggcagccagaacactggccccaccgcagggtgcccgtccctggctccttggctcctgcatggcagccagctggccgcgccctggctgaccgctgctctctctcttctctcccggctacag

SEQ ID NO: 2278 - DNA, 155 bp, Artificial Sequence
  Synthetic oligonucleotide
atggctgttccatccactgagggaccagcaggcctggaatgatgagcagcgtgtgtctgggaaactctaaagggcgacctggacagacctgattgcttaaagttaaaaaaatgaagttttcagtgtgccaaacaaaacattggcagctttgaaag

SEQ ID NO: 2279 - DNA, 1388 bp, Artificial Sequence
  Synthetic oligonucleotide
gagaagaccaggaatgagctgagtctgaaagacagggttgagagaatagggaggctggagagcaggccctgagccagagcgcgtgaggggtccacactcactgctaccccacgatgactcaggaaggcccctttgtttcatgctgaaacctgcagagatattagaatgacacccatgggtgggagggaggaggagtggacaagctgctcagatggaggggcccagccagcccaacttcatgccctcatctcgtcagtggctgctcggaaccaaagaggtcatctgccctggccacagggagcctgccctgaacacaggcctcacctgtcctgtgctcggacaccacaggctgactcactcaggggtttagccagaaaagcttggggtcttaccaggatgccgcagagcctgccaggttcaagtcatgaaggaatcgagcagacacatgttacatttactgatgatgctaattacacaggctgctcatatttctaaagcaggagttttcaaactttgttagtggcagaacttttgtcaaatggagtcttacccagagtcagaatctagccaccaaaatgggaagggagtggagctgccctgtccacaggcttctctatgggaaaggctgctgttctgtaaaacatggtggggcgggctgtggggaggaaggcattttctggaccacatgaacgaattcgagttgggggacggtcctaccccagtgaggaagctgaaagaaatgggcctgatttggtgcaggacagcccctgaagaccgtgaggccctggcctctgccgcagatgggagcctcagcagcagggtctagggcagcacccagggcatccttgccacgtgaggctgccgttggtgcctgggcatcagtagctcaggctggaataattggaaaggaaaaggcaggaggagcccctgaggccaggccattgggctggggagctgttaagctgaggtggccctagggcctgccggggctgggggtggcaagccaaaccggaggcaccagccaggcccacaggacacaggaggcagagccgtgaggcctggtcagagcaggtggagtgctagtgtggagactgcagggagagaccacccgagccatcagctgaggactgtggcggcccagcaggagtaacactgttgaggagaacccagcccaagcctgaggaggctggaggtgccatacggctcctgcgtgcgcctggtgtcttgcccacgctcaccgctttcttggtcagggcagtcccggctgcagcctctcactcatcacattctcatctctcatctgtctgatgttcccacctccctgtccagccccagggttaggtgagagcagctactcagtcctggccactgtcccctcccctctgcag

SEQ ID NO: 2280 - DNA, 1104 bp, Artificial Sequence
  Synthetic oligonucleotide
gatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggaggg

SEQ ID NO: 2281 - DNA, 416 bp, Artificial Sequence
  Synthetic oligonucleotide
ctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacagagcttcctgcctcagtctctgggtatttgcggggggcgggtttggtctgaatgcagctgacatgtcagactcaccactggctgctgctggagaggtagcaatagtggttcccctgcacccgggccacctcagatgctggtacttacttaaccaagggatttggc

SEQ ID NO: 2282 - DNA, 125 bp, Artificial Sequence
  Synthetic oligonucleotide
ctggcactgccccctgccagtgctgcagcgtgccatccgcaaggcaggcctgccaacgctgcttcccaggccagcagggccctaaagcttggcagaaacttcaagccagaaagaaaccacgccag

SEQ ID NO: 2283 - DNA, 56 bp, Artificial Sequence
  Synthetic oligonucleotide
ctgggtctctggccgagggggccggaccgcagccgccgccctcccaggaccccgag

SEQ ID NO: 2284 - DNA, 99 bp, Artificial Sequence
  Synthetic oligonucleotide
cacttagagcaagagaaacatgaattgagaagacgatttgagaaccgagaaggggagtgggaaggccgagtgtcagagctggagagtgatgtgaagcag

SEQ ID NO: 2285 - DNA, 117 bp, Artificial Sequence
  Synthetic oligonucleotide
ctacaggatgagttggagaggcagcagattcatctgcgggaagcagatcgagaaaaatcacgggctgtccaggaactgtcggaacagaaccaaaggctattggatcagctcagcagg

SEQ ID NO: 2286 - DNA, 117 bp, Artificial Sequence
  Synthetic oligonucleotide
gcatcagaagttgagagacaactctccatgcaggtccacgccctcagagaagactttcgggagaaaaactcatcaaccaaccagcacattatccggctggagagccttcaggccgag

SEQ ID NO: 2287 - DNA, 54 bp, Artificial Sequence
  Synthetic oligonucleotide
ctgagactgcagctctgggaagcctactgccaggttcgctatctgtgctcacac

SEQ ID NO: 2288 - DNA, 106 bp, Artificial Sequence
  Synthetic oligonucleotide
cttcgaggcaatgacagtgctgactcagccgtctccacggactcctccatggacgagtcttcagaaacctcgtccgccaaggatgtgccagccggcagcttgcgca

SEQ ID NO: 2289 - DNA, 59 bp, Artificial Sequence
  Synthetic oligonucleotide
ctgccctcaatgagctcaagagactgatacagagcattgtggatggcatggagcccacg

SEQ ID NO: 2290 - DNA, 97 bp, Artificial Sequence
  Synthetic oligonucleotide
ggctcccggagacttgatgatgactccttagaagaacagataaggcagaccagtgaggactcgagagccctaagggagctcatggagggagagaggg

SEQ ID NO: 2291 - DNA, 47 bp, Artificial Sequence
  Synthetic oligonucleotide
gtaaactgaggcaaagcctagaagagctgcagcgactccacagtcag

SEQ ID NO: 2292 - DNA, 39 bp, Artificial Sequence
  Synthetic oligonucleotide
gtgacactgctgagtgtggagatgactgccctaaaagag

SEQ ID NO: 2293 - DNA, 92 bp, Artificial Sequence
  Synthetic oligonucleotide
gagagagaccgactcagagtcacttctgaggacaaggagccaaaggagcagcttcagaaggccatcagggaccgcgacgaggccattgcaaa

SEQ ID NO: 2294 - DNA, 109 bp, Artificial Sequence
  Synthetic oligonucleotide
tttgcttcctcagggctttttactatctggctcctttggtttctgatctagtggcctttctcagttcccgtatcaacagctttagttgtacacccctcctgcctttgag

SEQ ID NO: 2295 - DNA, 37 bp, Artificial Sequence
  Synthetic oligonucleotide
ggaggctgccggaagcctccagatgctgcctgcctgc

SEQ ID NO: 2296 - DNA, 40 bp, Artificial Sequence
  Synthetic oligonucleotide
ctgcagaagcctgcagtggctgctgctcctgcctctgcag

SEQ ID NO: 2297 - DNA, 36 bp, Artificial Sequence
  Synthetic oligonucleotide
ccgcccctcctcctccacccaggccccaactcagag

SEQ ID NO: 2298 - DNA, 25 bp, Artificial Sequence
  Synthetic oligonucleotide
gctccgcggcccggccagccctcag

SEQ ID NO: 2299 - DNA, 5654 bp, Homo sapiens
gggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataatttaggaagattttattttttggatgttgtcagaaattacagcaatatattcataaatacctaattactacattcaacaaataatattacaatacaattaattcaaacaagtacacttagaacaggtttaatttcacagcatctaaactgcccccagagtgaccgaggcaccggtgttcctccctcccacctgcgtatggggtttactgttatagaattaagcacagggtacatacaaaataacaccagttagcatggtcttcctcaggtcaaggcagagttaaggagttttttaggttaagcactggatggaaaagttggggacaggctactgcaagtagtaagaaagtcaacagcttggttacttgaaagaatatagagattgctaagtggctaatatacactttaaagaggaacagaatcggtttgtgctgaccatctccatcttgtggtggatccctggcattttctacacttgtgtgaaacatgtggctcagggaaaggggtaggatctggtgtgaaattcagcttaacttttgagatttggcagtattatgagctacttgaggaaaataccattctgctacaaactgcagattccctgtgttagaatccttcactgctgaaggtgtgggctccttttgatgctctctgaatactcttaagggtgcaacctatcagaatgttagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtaggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcagactccctctgaacacctgtggaacatgctgacctcccagtgtctttcgaggggaggcctgcagcacagcccctcgagttctcttccagctgcttctgtggagaggaaggtgcttgttgactgctgataatactggcggtacattcgtctgagtttgctaataactggaagattcttggcagacgtacaaagcaaactgtgcgggggcagataaagcgacacgatgccagctgccagcaagctgttctgcgcagcaagggctagggccaagggctcggctgctggtcacagcagtgagcagccggcacacaggtcaggcaccctgccctcagctcaggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacag

SEQ ID NO: 2300 - DNA, 4856 bp, Homo sapiens
gggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataatttaggaagattttattttttggatgttgtcagaaattacagcaatatattcataaatacctaattactacattcaacaaataatattacaatacaattaattcaaacaagtacacttagaacaggtttaatttcacagcatctaaactgcccccagagtgaccgaggcaccggtgttcctccctcccacctgcgtatggggtttactgttatagaattaagcacagggtacatacaaaataacaccagttagcatggtcttcctcaggtcaaggcagagttaaggagttttttaggttaagcactggatggaaaagttggggacaggctactgcaagtagtaagaaagtcaacagcttggttacttgaaagaatatagagattgctaagtggctaatatacactttaaagaggaacagaatcggtttgtgctgaccatctccatcttgtggtggatccctggcattttctacacttgtgtgaaacatgtggctcagggaaaggggtaggatctggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcagactccctctgaacacctgtggaacatgctgacctcccagtgtctttcgaggggaggcctgcagcacagcccctcgagttctcttccagctgcttctgtggagaggaaggtgcttgttgactgctgataatactggcggtacattcgtctgagtttgctaataactggaagattcttggcagacgtacaaagcaaactgtgcgggggcagataaagcgacacgatgccagctgccagcaagctgttctgcgcagcaagggctagggccaagggctcggctgctggtcacagcagtgagcagccggcacacaggtcaggcaccctgccctcagctcaggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacag

SEQ ID NO: 2301 - DNA, 7923 bp, Homo sapiens
gggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcagtaagtagatctcacctcttagaggccacacccaagactggactcgccatgcccttcccctaaccctcgtccttcctctccgcttccctgcttattgcctcagtaagtggcaacactggccgccctgtttctcaggtcagtgaccatgaggtcatctgtgtacacacacctgccaggtgcactctgtctgtctctgtgtgtctttctgtctgttctttgcctttctctgtctctcatttttccttttctccacttcccggtgaagcccttggctctttttgttctgcctcacatcactcgacattggaccccagtgtgagccaccagcatctcacagaatcggcagtagccattctttgccatgtatgtgttttatttagcacagctttactcctgtttctccttggagtaggtggatttgagtttttttgtgtctttcgcaggaaaggccagagggcttgtgcttaggctgagatgaggctgcagtcagcccatgaatttcataaaaagctgagaagcagcaatgcaccaagcattccactcggcagtggcgtttgtcccataggcctgcttcctggtgtggtgcgggagagatgtgggcctgggagcctatagtgaatcttcagtgtgaccaatgctcttgacagtccatcagagcgcagtaaggccaggtggtgccagagagggctcacagaggtttgctgggagtgcagacttgtaggaggtggacggtaggggagagggcagtgaggcaggaactgatatgctcaggcagagtgtgaaggacctggtgtagccgggcaagcagagatatttgaggatgtgtagtacattcatgggagcagaggaatggaggcataggttctgctgcagtggccagcccctgggaggggcatgtggcctcagagggacctgagagagactgtagtggtggtggggatggtagctggaagggagaggatctataaacaggctaggtaagaatttggcattagctaggtgagggggcctatccattttttgtttttgaagttcaatatattatggatgtagtttttatcaaaaaccttgttttataattcattcggttaagggacttaattttacgtttgttctatagttcagctgacgaggagttggggtcctttgtcctttaacctgctgttcagagcacaagatctaaatgtttgggtttataaataaaactcactacataaattttgtaccagtggtttgccacttactcatcaggaattaattgtagcatatggagagaatgtctagcgtaacctgtaatgcctagtgacgaacaatatttgcttctgcttttatcgtgtagtttttcttcaaaggttagtttaaaatacttcacaacgggagcctcgactttgtgaaagccttccttcatcccttgctggctttgagcttctagccagaattttgctatgtgtaggtgtgctcactgtatactaatttgcagtttcttctgtgatttttgaaacttgtttttgtcttctctgaagagcaggagagtcccttcccttcagggcttttgtgaggatagaaatgccaggtaaagtgctgagcccagtacctggcatggagttggcgttttccttctctaggctgtgagccctggattcctggtggggaatagggagatctgctcaacactctgtaaatgaggagcaatagaactcgacctttgagccagccctcgaaactgattccttgtagatggaggttaggcagcacggaatgctgttatcctgagacagaggcttctgacttagagctgattctctactaattttcttaggtaaacagcagtcctgttcagcagcctgccatgggatagttaatgtgagcaaaagaaactccatgtggatcactgccgcaccaagcttaactgctacaaatctttacaccctaaagttgaaaataaagcaaaacagactttctgagtctggaatagccacggtattttgcctgaaaagagccactctatccagcattgcctcaggttatcaagtgttccccgactgactttagcccttgctcctttagtgcttcagacaacatcccgaaggcagacgaaatccggaccctggtcaaggatatgtgggacactcgtatagccaaactccgagtgtctgctgacagctttgtgagacagcaggaggcacatgccaaggtaggtgccgccttgcctgggtgctggtggccttgatgccgcataatttcacatggctcccgtctgctgaggctattacaggcaggcattactagctgtgcttttcaacagttcattggtttcttatttttattcagtagagtttacctttttctcaaaatcaaaaactccttggccaacttggtctgttttcttgctttagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataatttaggaagattttattttttggatgttgtcagaaattacagcaatatattcataaatacctaattactacattcaacaaataatattacaatacaattaattcaaacaagtacacttagaacaggtttaatttcacagcatctaaactgcccccagagtgaccgaggcaccggtgttcctccctcccacctgcgtatggggtttactgttatagaattaagcacagggtacatacaaaataacaccagttagcatggtcttcctcaggtcaaggcagagttaaggagttttttaggttaagcactggatggaaaagttggggacaggctactgcaagtagtaagaaagtcaacagcttggttacttgaaagaatatagagattgctaagtggctaatatacactttaaagaggaacagaatcggtttgtgctgaccatctccatcttgtggtggatccctggcattttctacacttgtgtgaaacatgtggctcagggaaaggggtaggatctggtgtgaaattcagcttaacttttgagatttggcagtattatgagctacttgaggaaaataccattctgctacaaactgcagattccctgtgttagaatccttcactgctgaaggtgtgggctccttttgatgctctctgaatactcttaagggtgcaacctatcagaatgttagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtaggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcagactccctctgaacacctgtggaacatgctgacctcccagtgtctttcgaggggaggcctgcagcacagcccctcgagttctcttccagctgcttctgtggagaggaaggtgcttgttgactgctgataatactggcggtacattcgtctgagtttgctaataactggaagattcttggcagacgtacaaagcaaactgtgcgggggcagataaagcgacacgatgccagctgccagcaagctgttctgcgcagcaagggctagggccaagggctcggctgctggtcacagcagtgagcagccggcacacaggtcaggcaccctgccctcagctcaggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacag

SEQ ID NO: 2302 - DNA, 5776 bp, Homo sapiens
cgagtagctggattgtgagcccccgcgcccgcccggctttgcgttttcagtatgagggaggcgcctcggcgctgggagtcctggagaaggagggcaggctctgtacctgcccagacccacctccccgcaccccaggaccccaacattgggtgtgtgaaacctgttccggagttggagggtgcaggcgggagagggagcgccccccacccactcaggggagacttgcatcctgtccgcggaaaggccagaaggactgagccccacgctcgcaggtgtctcggagccgctcaggaggcgctttgttctgagtctgggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataatttaggaagattttattttttggatgttgtcagaaattacagcaatatattcataaatacctaattactacattcaacaaataatattacaatacaattaattcaaacaagtacacttagaacaggtttaatttcacagcatctaaactgcccccagagtgaccgaggcaccggtgttcctccctcccacctgcgtatggggtttactgttatagaattaagcacagggtacatacaaaataacaccagttagcatggtcttcctcaggtcaaggcagagttaaggagttttttaggttaagcactggatggaaaagttggggacaggctactgcaagtagtaagaaagtcaacagcttggttacttgaaagaatatagagattgctaagtggctaatatacactttaaagaggaacagaatcggtttgtgctgaccatctccatcttgtggtggatccctggcattttctacacttgtgtgaaacatgtggctcagggaaaggggtaggatctggtgtgaaattcagcttaacttttgagatttggcagtattatgagctacttgaggaaaataccattctgctacaaactgcagattccctgtgttagaatccttcactgctgaaggtgtgggctccttttgatgctctctgaatactcttaagggtgcaacctatcagaatgttagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtaggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcagactccctctgaacacctgtggaacatgctgacctcccagtgtctttcgaggggaggcctgcagcacagcccctcgagttctcttccagctgcttctgtggagaggaaggtgcttgttgactgctgataatactggcggtacattcgtctgagtttgctaataactggaagattcttggcagacgtacaaagcaaactgtgcgggggcagataaagcgacacgatgccagctgccagcaagctgttctgcgcagcaagggctagggccaagggctcggctgctggtcacagcagtgagcagccggcacacaggtcaggcaccctgccctcagctcaggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacag

SEQ ID NO: 2303 - DNA, 5900 bp, Homo sapiens
ggcctgtgagctttacggctttttttcaccttcccagtgaccctctatggggcttcagggaggttggagaggagagcatccggttagctggggcgggggcagggggtgctttctgctggaattccaaaccctggaatcctcatgtctcctgtgatttttctcgcgggcctaattatcaaggtttcaaattcgactgcagtcctagaatagcgcttcacccccaggaagcttttccggccatgaccaccccatcaaaatcacctggccctggatgaaattcagctttctgtcctttccacgactccggaatcccaactcccaggagcgtgcacacagacaatgggcacccgctaggggattctgacacaggtgagctccagccaccgctctggcttcacctgcgcccactgtacaggggcagccggtccagcgagcagggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataatttaggaagattttattttttggatgttgtcagaaattacagcaatatattcataaatacctaattactacattcaacaaataatattacaatacaattaattcaaacaagtacacttagaacaggtttaatttcacagcatctaaactgcccccagagtgaccgaggcaccggtgttcctccctcccacctgcgtatggggtttactgttatagaattaagcacagggtacatacaaaataacaccagttagcatggtcttcctcaggtcaaggcagagttaaggagttttttaggttaagcactggatggaaaagttggggacaggctactgcaagtagtaagaaagtcaacagcttggttacttgaaagaatatagagattgctaagtggctaatatacactttaaagaggaacagaatcggtttgtgctgaccatctccatcttgtggtggatccctggcattttctacacttgtgtgaaacatgtggctcagggaaaggggtaggatctggtgtgaaattcagcttaacttttgagatttggcagtattatgagctacttgaggaaaataccattctgctacaaactgcagattccctgtgttagaatccttcactgctgaaggtgtgggctccttttgatgctctctgaatactcttaagggtgcaacctatcagaatgttagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtaggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcagactccctctgaacacctgtggaacatgctgacctcccagtgtctttcgaggggaggcctgcagcacagcccctcgagttctcttccagctgcttctgtggagaggaaggtgcttgttgactgctgataatactggcggtacattcgtctgagtttgctaataactggaagattcttggcagacgtacaaagcaaactgtgcgggggcagataaagcgacacgatgccagctgccagcaagctgttctgcgcagcaagggctagggccaagggctcggctgctggtcacagcagtgagcagccggcacacaggtcaggcaccctgccctcagctcaggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacag

SEQ ID NO: 2304 - DNA, 437 bp, Artificial Sequence
  Synthetic oligonucleotide
ggcctgtgagctttacggctttttttcaccttcccagtgaccctctatggggcttcagggaggttggagaggagagcatccggttagctggggcgggggcagggggtgctttctgctggaattccaaaccctggaatcctcatgtctcctgtgatttttctcgcgggcctaattatcaaggtttcaaattcgactgcagtcctagaatagcgcttcacccccaggaagcttttccggccatgaccaccccatcaaaatcacctggccctggatgaaattcagctttctgtcctttccacgactccggaatcccaactcccaggagcgtgcacacagacaatgggcacccgctaggggattctgacacaggtgagctccagccaccgctctggcttcacctgcgcccactgtacaggggcagccggtccagcgagcag

SEQ ID NO: 2305 - DNA, 191 bp, Artificial Sequence
  Synthetic oligonucleotide
gggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcggg

SEQ ID NO: 2306 - DNA, 313 bp, Artificial Sequence
  Synthetic oligonucleotide
cgagtagctggattgtgagcccccgcgcccgcccggctttgcgttttcagtatgagggaggcgcctcggcgctgggagtcctggagaaggagggcaggctctgtacctgcccagacccacctccccgcaccccaggaccccaacattgggtgtgtgaaacctgttccggagttggagggtgcaggcgggagagggagcgccccccacccactcaggggagacttgcatcctgtccgcggaaaggccagaaggactgagccccacgctcgcaggtgtctcggagccgctcaggaggcgctttgttctgagtctg

SEQ ID NO: 2307 - DNA, 458 bp, Artificial Sequence
  Synthetic oligonucleotide
gtaagtagatctcacctcttagaggccacacccaagactggactcgccatgcccttcccctaaccctcgtccttcctctccgcttccctgcttattgcctcagtaagtggcaacactggccgccctgtttctcaggtcagtgaccatgaggtcatctgtgtacacacacctgccaggtgcactctgtctgtctctgtgtgtctttctgtctgttctttgcctttctctgtctctcatttttccttttctccacttcccggtgaagcccttggctctttttgttctgcctcacatcactcgacattggaccccagtgtgagccaccagcatctcacagaatcggcagtagccattctttgccatgtatgtgttttatttagcacagctttactcctgtttctccttggagtaggtggatttgagtttttttgtgtctttcgcaggaaaggccagagggc

SEQ ID NO: 2308 - DNA, 1609 bp, Artificial Sequence
  Synthetic oligonucleotide
ttgtgcttaggctgagatgaggctgcagtcagcccatgaatttcataaaaagctgagaagcagcaatgcaccaagcattccactcggcagtggcgtttgtcccataggcctgcttcctggtgtggtgcgggagagatgtgggcctgggagcctatagtgaatcttcagtgtgaccaatgctcttgacagtccatcagagcgcagtaaggccaggtggtgccagagagggctcacagaggtttgctgggagtgcagacttgtaggaggtggacggtaggggagagggcagtgaggcaggaactgatatgctcaggcagagtgtgaaggacctggtgtagccgggcaagcagagatatttgaggatgtgtagtacattcatgggagcagaggaatggaggcataggttctgctgcagtggccagcccctgggaggggcatgtggcctcagagggacctgagagagactgtagtggtggtggggatggtagctggaagggagaggatctataaacaggctaggtaagaatttggcattagctaggtgagggggcctatccattttttgtttttgaagttcaatatattatggatgtagtttttatcaaaaaccttgttttataattcattcggttaagggacttaattttacgtttgttctatagttcagctgacgaggagttggggtcctttgtcctttaacctgctgttcagagcacaagatctaaatgtttgggtttataaataaaactcactacataaattttgtaccagtggtttgccacttactcatcaggaattaattgtagcatatggagagaatgtctagcgtaacctgtaatgcctagtgacgaacaatatttgcttctgcttttatcgtgtagtttttcttcaaaggttagtttaaaatacttcacaacgggagcctcgactttgtgaaagccttccttcatcccttgctggctttgagcttctagccagaattttgctatgtgtaggtgtgctcactgtatactaatttgcagtttcttctgtgatttttgaaacttgtttttgtcttctctgaagagcaggagagtcccttcccttcagggcttttgtgaggatagaaatgccaggtaaagtgctgagcccagtacctggcatggagttggcgttttccttctctaggctgtgagccctggattcctggtggggaatagggagatctgctcaacactctgtaaatgaggagcaatagaactcgacctttgagccagccctcgaaactgattccttgtagatggaggttaggcagcacggaatgctgttatcctgagacagaggcttctgacttagagctgattctctactaattttcttaggtaaacagcagtcctgttcagcagcctgccatgggatagttaatgtgagcaaaagaaactccatgtggatcactgccgcaccaagcttaactgctacaaatctttacaccctaaagttgaaaataaagcaaaacagactttctgagtctggaatagccacggtattttgcctgaaaagagccactctatccagcattgcctcaggttatcaagtgttccccgactgactttagcccttgctcctttag

SEQ ID NO: 2309 - DNA, 127 bp, Artificial Sequence
  Synthetic oligonucleotide
tgcttcagacaacatcccgaaggcagacgaaatccggaccctggtcaaggatatgtgggacactcgtatagccaaactccgagtgtctgctgacagctttgtgagacagcaggaggcacatgccaag

SEQ ID NO: 2310 - DNA, 202 bp, Artificial Sequence
  Synthetic oligonucleotide
gtaggtgccgccttgcctgggtgctggtggccttgatgccgcataatttcacatggctcccgtctgctgaggctattacaggcaggcattactagctgtgcttttcaacagttcattggtttcttatttttattcagtagagtttacctttttctcaaaatcaaaaactccttggccaacttggtctgttttcttgctttag

SEQ ID NO: 2311 - DNA, 260 bp, Artificial Sequence
  Synthetic oligonucleotide
ctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcagga

SEQ ID NO: 2312 - DNA, 137 bp, Artificial Sequence
  Synthetic oligonucleotide
tgttgttggagaaacaagtttgtgattagtccttaaaacttagctccctgggacattcttcaattccacatctgtttctagaaaccagccctttttccccccacttttgagaaataaaaaagccttaggtaaataag

SEQ ID NO: 2313 - DNA, 2258 bp, Artificial Sequence
  Synthetic oligonucleotide
tcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataatttaggaagattttattttttggatgttgtcagaaattacagcaatatattcataaatacctaattactacattcaacaaataatattacaatacaattaattcaaacaagtacacttagaacaggtttaatttcacagcatctaaactgcccccagagtgaccgaggcaccggtgttcctccctcccacctgcgtatggggtttactgttatagaattaagcacagggtacatacaaaataacaccagttagcatggtcttcctcaggtcaaggcagagttaaggagttttttaggttaagcactggatggaaaagttggggacaggctactgcaagtagtaagaaagtcaacagcttggttacttgaaagaatatagagattgctaagtggctaatatacactttaaagaggaacagaatcggtttgtgctgaccatctccatcttgtggtggatccctggcattttctacacttgtgtgaaacatgtggctcagggaaaggggtaggatctg

SEQ ID NO: 2314 - DNA, 798 bp, Artificial Sequence
  Synthetic oligonucleotide
gtgtgaaattcagcttaacttttgagatttggcagtattatgagctacttgaggaaaataccattctgctacaaactgcagattccctgtgttagaatccttcactgctgaaggtgtgggctccttttgatgctctctgaatactcttaagggtgcaacctatcagaatgttagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtag

SEQ ID NO: 2315 - DNA, 1668 bp, Artificial Sequence
  Synthetic oligonucleotide
gtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcagactccctctgaacacctgtggaacatgctgacctcccagtgtctttcgaggggaggcctgcagcacagcccctcgagttctcttccagctgcttctgtggagaggaaggtgcttgttgactgctgataatactggcggtacattcgtctgagtttgctaataactggaagattcttggcagacgtacaaagcaaactgtgcgggggcagataaagcgacacgatgccagctgccagcaagctgttctgcgcagcaagggctagggccaagggctcggctgctggtcacagcagtgagcagccggcacacaggtcaggcaccctgccctcagctcaggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacag

SEQ ID NO: 2316 - DNA, 115 bp, Artificial Sequence
  Synthetic oligonucleotide
ggggacctggggccttttaaccctggtttacccgtggaagtgcccctgtggctggcgattaacctgaaacaaagacagaaatgtcgcctgctccctccagagtggatggatgtag

SEQ ID NO: 2317 - DNA, 100 bp, Artificial Sequence
  Synthetic oligonucleotide
aaaagttggagaagatgagggatcatgaacgaaaggaagaaacttttaccccaatgcccagcccttactacatggaacttacgaagctcctgttaaatca

SEQ ID NO: 2318 - DNA, 3087 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2319 - DNA, 3600 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtaactatacaaggtagccctccccaacactgagctggcaggtctccagtccttcctcagacacaccgggcaccatcccatcagaggaaactgctcctggaactgtcccccatgcccttgtcactgcacagatggcattgcagggctctccctgagtgtgccctgtcccacttacatggcacacatgggagtgcctcactgactctgcacctggcttgttaattacctcccccactggagtgcctgctggggaaagacagtgtccctcacacattattggtgcccatacgtttattcactgcattattcaagaaacaagaaaggaatcccaaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2320 - DNA, 3100 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtaactatacaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2321 - DNA, 3750 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtaactatacaaggtagccctccccaacactgagctggcaggtctccagtccttcctcagacacaccgggcaccatcccatcagaggaaactgctcctggaactgtcccccatgcccttgtcactgcacagatggcattgcagggctctccctgagtgtgccctgtcccacttacatggcacacatgggagtgcctcactgactctgcacctggcttgttaattacctcccccactggagtgcctgctggggaaagacagtgtccctcacacattattggtgcccatacgtttattcactgcattattcaagaaacaagaaaggaatcccaaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2322 - DNA, 3681 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtaactatacaaggtagccctccccaacactgagctggcaggtctccagtccttcctcagacacaccgggcaccatcccatcagaggaaactgctcctggaactgtcccccatgcccttgtcactgcacagatggcattgcagggctctccctgagtgtgccctgtcccacttacatggcacacatgggagtgcctcactgactctgcacctggcttgttaattacctcccccactggagtgcctgctggggaaagacagtgtccctcacacattattggtgcccatacgtttattcactgcattattcaagaaacaagaaaggaatcccaaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacaggtgtgaccagccacgtggatgatgaataccgatgggcaggagtcgaggatcccaaggttatgatcactacctcccgagaccccagttcccgcctcaagatgtttgcaaaggtactggtgagcagggagtgagggagagacacccaggacacacagccccagtcctgactgtacactgccatccacgcccaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2323 - DNA, 1901 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 2324 - DNA, 3331 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctggtaaggccggagggagggagtcggggtgggagccgtctgagggcagacggggtctctgacagccacctttccccgccagtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtgagtctgggggccttcaggctggggctgcgggccaggccaggcatttgccactctgtttccctctctttccttgtgccccaggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagcgtgagtttgaggctgaatcccgtgtctggggtggggaggggaggctggctgtgccggggctgatgccatccctgcctgcagtgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2325 - DNA, 2932 bp, Homo sapiens
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 2326 - DNA, 722 bp, Artificial Sequence
  Synthetic oligonucleotide
caaggggcgttcccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatg

SEQ ID NO: 2327 - DNA, 123 bp, Artificial Sequence
  Synthetic oligonucleotide
gtccggggcgcgtgaagtgctggggatgtggctctggggacttggaggctcagcggctccggggctccggggttccggggctcgggagcgagtagtgagtgactgggcctgctgttcccacag

SEQ ID NO: 2328 - DNA, 650 bp, Artificial Sequence
  Synthetic oligonucleotide
gtagccctccccaacactgagctggcaggtctccagtccttcctcagacacaccgggcaccatcccatcagaggaaactgctcctggaactgtcccccatgcccttgtcactgcacagatggcattgcagggctctccctgagtgtgccctgtcccacttacatggcacacatgggagtgcctcactgactctgcacctggcttgttaattacctcccccactggagtgcctgctggggaaagacagtgtccctcacacattattggtgcccatacgtttattcactgcattattcaagaaacaagaaaggaatcccaaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacag

SEQ ID NO: 2329 - DNA, 120 bp, Artificial Sequence
  Synthetic oligonucleotide
gagctgaagctggtgttcccgggcgcccagcgaatgaaccgaggtcgacatgaagtgggggcactggtgcgagcctgcaaagccaacggcgtcaccgatctgctggtcgttcacgagcat

SEQ ID NO: 2330 - DNA, 456 bp, Artificial Sequence
  Synthetic oligonucleotide
cttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccac

SEQ ID NO: 2331 - DNA, 120 bp, Artificial Sequence
  Synthetic oligonucleotide
cagctgattcctcatgtaagtggcatcatgtggtatttgttttgtgtctggcttatttctattaacataatgttctccaggttcctccatgttattgcaaatgataggatttctttcctt

SEQ ID NO: 2332 - DNA, 1212 bp, Artificial Sequence
  Synthetic oligonucleotide
gtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagctacccagtctgtggtattttgttagaacagcccaagttgagacagatagtaaccctttaccagatacatggtttgcaaatagtttttcccactctgtagatatagccattgagaagctcctcaagatagacattaaatacaaagaagcatggtgtgaaacgccatgtgtgatatgctgtcagtgtgcaaaagaggcagggagggccctgcacttgcatgtatgtgctgcatcatccccagaaggctgaactccttgctggtgcactgggtacccagggaggagggaggttctttactgtaatgttagcaggtgaacattgtatccacttgaccacgaagaactgccctcttgagttctctgcccattttttgggggggtacaggcggacacttggaagacatccttatgataaaaaagcatacagaaggcctggtgcagtcactcacacctgtaataatcccagcgctttgggaggtcaaggcaaggaggttcactt

SEQ ID NO: 2333 - DNA, 22 bp, Artificial Sequence
  Synthetic oligonucleotide
gtaggagaatgagctcctgttt

SEQ ID NO: 2334 - DNA, 5 bp, Artificial Sequence
  Synthetic oligonucleotide
cggag

SEQ ID NO: 2335 - DNA, 109 bp, Artificial Sequence
  Synthetic oligonucleotide
ctgcgccgcgaggcccgcctgcgccgcgagtacctgtaccgcaaggcccgggaggaggcgcagcgctcagcccaggagaggaaggagcggctgcggcgcgcgctggaag

SEQ ID NO: 2336 - DNA, 78 bp, Artificial Sequence
  Synthetic oligonucleotide
aaaaccgcctgattcccactgagttacgccgagaggctctggccttacaggggtccctggagtttgatgatgctggag

SEQ ID NO: 2337 - DNA, 6 bp, Artificial Sequence
  Synthetic oligonucleotide
gtgaag

SEQ ID NO: 2338 - DNA, 13 bp, Artificial Sequence
  Synthetic oligonucleotide
gtaactatacaag

SEQ ID NO: 2339 - DNA, 110 bp, Artificial Sequence
  Synthetic oligonucleotide
gtgtgaccagccacgtggatgatgaataccgatgggcaggagtcgaggatcccaaggttatgatcactacctcccgagaccccagttcccgcctcaagatgtttgcaaag

SEQ ID NO: 2340 - DNA, 81 bp, Artificial Sequence
  Synthetic oligonucleotide
gtactggtgagcagggagtgagggagagacacccaggacacacagccccagtcctgactgtacactgccatccacgcccag

SEQ ID NO: 2341 - DNA, 13 bp, Artificial Sequence
  Synthetic oligonucleotide
cggggcacacctg

SEQ ID NO: 2342 - DNA, 79 bp, Artificial Sequence
  Synthetic oligonucleotide
gtaaggccggagggagggagtcggggtgggagccgtctgagggcagacggggtctctgacagccacctttccccgccag

SEQ ID NO: 2343 - DNA, 77 bp, Artificial Sequence
  Synthetic oligonucleotide
tggggctcatcgtcagccacctgccctttggtcctactgcctacttcacgctgtgcaatgtggtcatgcggcatgac

SEQ ID NO: 2344 - DNA, 9 bp, Artificial Sequence
  Synthetic oligonucleotide
atcccagac

SEQ ID NO: 2345 - DNA, 69 bp, Artificial Sequence
  Synthetic oligonucleotide
ctgggcaccatgtcggaggccaagccccacctcatcacacacggcttctcctcccgcctgggcaagcgg

SEQ ID NO: 2346 - DNA, 84 bp, Artificial Sequence
  Synthetic oligonucleotide
gtgagtctgggggccttcaggctggggctgcgggccaggccaggcatttgccactctgtttccctctctttccttgtgccccag

SEQ ID NO: 2347 - DNA, 9 bp, Artificial Sequence
  Synthetic oligonucleotide
gtctctgac

SEQ ID NO: 2348 - DNA, 53 bp, Artificial Sequence
  Synthetic oligonucleotide
atcctccgatacctatttcccgtgcccaaagatgacagccaccgggtcatcac

SEQ ID NO: 2349 - DNA, 33 bp, Artificial Sequence
  Synthetic oligonucleotide
cttcgcaaaccaggacgactacatatcattccg

SEQ ID NO: 2350 - DNA, 49 bp, Artificial Sequence
  Synthetic oligonucleotide
gcaccatgtgtataagaagacagaccaccgcaacgtggagctcactgag

SEQ ID NO: 2351 - DNA, 25 bp, Artificial Sequence
  Synthetic oligonucleotide
gtcgggccccgctttgagctgaagc

SEQ ID NO: 2352 - DNA, 81 bp, Artificial Sequence
  Synthetic oligonucleotide
gtgagtttgaggctgaatcccgtgtctggggtggggaggggaggctggctgtgccggggctgatgccatccctgcctgcag

SEQ ID NO: 2353 - DNA, 84 bp, Artificial Sequence
  Synthetic oligonucleotide
tgtacatgatccgtctgggcacgctggagcaggaggccacagcagacgtggagtggcgctggcacccttacaccaataccgcac

SEQ ID NO: 2354 - DNA, 10 bp, Artificial Sequence
  Synthetic oligonucleotide
gcaagagagt

SEQ ID NO: 2355 - DNA, 13 bp, Artificial Sequence
  Synthetic oligonucleotide
acccagtgctcag

SEQ ID NO: 2356 - DNA, 55 bp, Artificial Sequence
  Synthetic oligonucleotide
gtaaaaaataacatgccacattttcttaccaatccgtccaccaatagacacttag

SEQ ID NO: 2357 - DNA, 3340 bp, Homo sapiens
gggggtaggggtgggggtgctttggactaacgtggagggaatggaaggcaggcctggttccaccctgcatgcccgaccctggccccagcagcccccacaaggagctcagctgaccctgggtgtctccctgtgatgggaaggggtaagacgaggactcaaaggcagaacctgcagagtgccccagacgctgatacctgcacagtcagtgccacccacccaggagttgaggaggcactgggttttggggtgaggacactggacacctccctgcttctttcccaggcagacaatcctggcgcagctcccttgggttgctgtgtctggtggagctgatcacaggtgaggggcagagggcagtctggggtccgcctatggccagaggagcaggtcagggcggcgccttgccgccccagctgtggcctgtttgctcaagacgctgaggtctcggggccagctaacaattgttgagcaaaatccttcgacaaacttcacctacgtgcaaggactcgaggagggaatcactcttaggagtgggagagtaatgtctttgcctgtgcccagtgaaggcccattggagctgcagctcagctaccactgtgtgggagagaagctggaagactgagggcttcctgggctgctggcccagggttgggagacagcagtcacctggcttaccaggcctatgcctgaagccctgggaagccaggacgcaggccccaggctgggacaaagctaccctgaaggagggcaaaggctgccaaggccaaccccatgcctgccaaggccaggcctggcccatttggccaaggcctaaggtgtaaaacaaggggagaggtacaagaggctgtggggtctggctgggatccttggggtcttccttctgcattctccaaacgcctagagccagcagaaacgtttcgtctgattagaagccatcatttctatcccaatcccggaaaattgactgcggtgcagagagggaggcctgagaagcagccgtaggggagaaggtccaagctaattaggaggcagcatccgggggcccattagagcgcaggctgctgtcactcagccgggctgagttcccgggagaagaggctggagaaggaggggcaggcggcccctcgacgaggacaccgctgggagctgccggaacgggccccgggctctgcccccgccccggcgctggctcgaaggcgcccgctcggtgcgatcctgttcggcaaacattcactcatcctgggctgttctcgccagggctggggacttcgaggcggccgagacgggagttgattctaggcgaaacaagtcatttgaggcctgaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 2358 - DNA, 3407 bp, Homo sapiens
gggggtaggggtgggggtgctttggactaacgtggagggaatggaaggcaggcctggttccaccctgcatgcccgaccctggccccagcagcccccacaaggagctcagctgaccctgggtgtctccctgtgatgggaaggggtaagacgaggactcaaaggcagaacctgcagagtgccccagacgctgatacctgcacagtcagtgccacccacccaggagttgaggaggcactgggttttggggtgaggacactggacacctccctgcttctttcccaggcagacaatcctggcgcagctcccttgggttgctgtgtctggtggagctgatcacaggtgaggggcagagggcagtctggggtccgcctatggccagaggagcaggtcagggcggcgccttgccgccccagctgtggcctgtttgctcaagacgctgaggtctcggggccagctaacaattgttgagcaaaatccttcgacaaacttcacctacgtgcaaggactcgaggagggaatcactcttaggagtgggagagtaatgtctttgcctgtgcccagtgaaggcccattggagctgcagctcagctaccactgtgtgggagagaagctggaagactgagggcttcctgggctgctggcccagggttgggagacagcagtcacctggcttaccaggcctatgcctgaagccctgggaagccaggacgcaggccccaggctgggacaaagctaccctgaaggagggcaaaggctgccaaggccaaccccatgcctgccaaggccaggcctggcccatttggccaaggcctaaggtgtaaaacaaggggagaggtacaagaggctgtggggtctggctgggatccttggggtcttccttctgcattctccaaacgcctagagccagcagaaacgtttcgtctgattagaagccatcatttctatcccaatcccggaaaattgactgcggtgcagagagggaggcctgagaagcagccgtaggggagaaggtccaagctaattaggaggcagcatccgggggcccattagagcgcaggctgctgtcactcagccgggctgagttcccgggagaagaggctggagaaggaggggcaggcggcccctcgacgaggacaccgctgggagctgccggaacgggccccgggctctgcccccgccccggcgctggctcgaaggcgcccgctcggtgcgatcctgttcggcaaacattcactcatcctgggctgttctcgccagggctggggacttcgaggcggccgagacgggagttgattctaggcgaaacaagtcatttgaggcctgaggtgtgcacgagccgcccgggactcgcaggccagatgcgtttcttttgtgaggccgagggagaactcggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 2359 - DNA, 3222 bp, Homo sapiens
gggggtaggggtgggggtgctttggactaacgtggagggaatggaaggcaggcctggttccaccctgcatgcccgaccctggccccagcagcccccacaaggagctcagctgaccctgggtgtctccctgtgatgggaaggggtaagacgaggactcaaaggcagaacctgcagagtgccccagacgctgatacctgcacagtcagtgccacccacccaggagttgaggaggcactgggttttggggtgaggacactggacacctccctgcttctttcccaggcagacaatcctggcgcagctcccttgggttgctgtgtctggtggagctgatcacaggtgaggggcagagggcagtctggggtccgcctatggccagaggagcaggtcagggcggcgccttgccgccccagctgtggcctgtttgctcaagacgctgaggtctcggggccagctaacaattgttgagcaaaatccttcgacaaacttcacctacgtgcaaggactcgaggagggaatcactcttaggagtgggagagtaatgtctttgcctgtgcccagtgaaggcccattggagctgcagctcagctaccactgtgtgggagagaagctggaagactgagggcttcctgggctgctggcccagggttgggagacagcagtcacctggcttaccaggcctatgcctgaagccctgggaagccaggacgcaggccccaggctgggacaaagctaccctgaaggagggcaaaggctgccaaggccaaccccatgcctgccaaggccaggcctggcccatttggccaaggcctaaggtgtaaaacaaggggagaggtacaagaggctgtggggtctggctgggatccttggggtcttccttctgcattctccaaacgcctagagccagcagaaacgtttcgtctgattagaagccatcatttctatcccaatcccggaaaattgactgcggtgcagagagggaggcctgagaagcagccgtaggggagaaggtccaagctaattaggaggcagcatccgggggcccattagagcgcaggctgctgtcactcagccgggctgagttcccgggagaagaggctggagaaggaggggcaggcggcccctcgacgaggacaccgctgggagctgccggaacgggccccgggctctgcccccgccccggcgctggctcgaaggcgcccgctcggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 2360 - DNA, 2215 bp, Homo sapiens
cggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 2361 - DNA, 2220 bp, Homo sapiens
cggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccaggtggggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 2362 - DNA, 2069 bp, Homo sapiens
gccgatcaagggatccggcccacgtgcgcggccgaagcccggagcagcccggctctggcccccgccccggctcctgcgcgtctccctccgcgctgcctttttttgtccgagctggagcttttttccagcagcgaactgggcccgcgggtggccggcgcgggcagtggggcagcgaatccgctgcccagcgcagccggccgggttccggaggggctccgagctccccggtgtgggcgcctcttctgcgttcatttcttaatacacagctgaatgtttctctccactttcttaagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgact

SEQ ID NO: 2363 - DNA, 580 bp, Homo sapiens
cggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcgg

SEQ ID NO: 2364 - DNA, 585 bp, Homo sapiens
cggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccaggtggggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcgg

SEQ ID NO: 2365 - DNA, 200 bp, Artificial Sequence
  Synthetic oligonucleotide
cggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccag

SEQ ID NO: 2366 - DNA, 380 bp, Artificial Sequence
  Synthetic oligonucleotide
gagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcgg

SEQ ID NO: 2367 - DNA, 1207 bp, Artificial Sequence
  Synthetic oligonucleotide
gggggtaggggtgggggtgctttggactaacgtggagggaatggaaggcaggcctggttccaccctgcatgcccgaccctggccccagcagcccccacaaggagctcagctgaccctgggtgtctccctgtgatgggaaggggtaagacgaggactcaaaggcagaacctgcagagtgccccagacgctgatacctgcacagtcagtgccacccacccaggagttgaggaggcactgggttttggggtgaggacactggacacctccctgcttctttcccaggcagacaatcctggcgcagctcccttgggttgctgtgtctggtggagctgatcacaggtgaggggcagagggcagtctggggtccgcctatggccagaggagcaggtcagggcggcgccttgccgccccagctgtggcctgtttgctcaagacgctgaggtctcggggccagctaacaattgttgagcaaaatccttcgacaaacttcacctacgtgcaaggactcgaggagggaatcactcttaggagtgggagagtaatgtctttgcctgtgcccagtgaaggcccattggagctgcagctcagctaccactgtgtgggagagaagctggaagactgagggcttcctgggctgctggcccagggttgggagacagcagtcacctggcttaccaggcctatgcctgaagccctgggaagccaggacgcaggccccaggctgggacaaagctaccctgaaggagggcaaaggctgccaaggccaaccccatgcctgccaaggccaggcctggcccatttggccaaggcctaaggtgtaaaacaaggggagaggtacaagaggctgtggggtctggctgggatccttggggtcttccttctgcattctccaaacgcctagagccagcagaaacgtttcgtctgattagaagccatcatttctatcccaatcccggaaaattgactgcggtgcagagagggaggcctgagaagcagccgtaggggagaaggtccaagctaattaggaggcagcatccgggggcccattagagcgcaggctgctgtcactcagccgggctgagttcccgggagaagaggctggagaaggaggggcaggcggcccctcgacgaggacaccgctgggagctgccggaacgggccccgggctctgcccccgccccggcgctggctcgaaggcgcccgctcg

SEQ ID NO: 2368 - DNA, 173 bp, Artificial Sequence
  Synthetic oligonucleotide
ctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccag

SEQ ID NO: 2369 - DNA, 291 bp, Artificial Sequence
  Synthetic oligonucleotide
gccgatcaagggatccggcccacgtgcgcggccgaagcccggagcagcccggctctggcccccgccccggctcctgcgcgtctccctccgcgctgcctttttttgtccgagctggagcttttttccagcagcgaactgggcccgcgggtggccggcgcgggcagtggggcagcgaatccgctgcccagcgcagccggccgggttccggaggggctccgagctccccggtgtgggcgcctcttctgcgttcatttcttaatacacagctgaatgtttctctccactttctta

SEQ ID NO: 2370 - DNA, 233 bp, Artificial Sequence
  Synthetic oligonucleotide
agaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgg

SEQ ID NO: 2371 - DNA, 569 bp, Artificial Sequence
  Synthetic oligonucleotide
cagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcg

SEQ ID NO: 2372 - DNA, 224 bp, Artificial Sequence
  Synthetic oligonucleotide
gggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgg

SEQ ID NO: 2373 - DNA, 435 bp, Artificial Sequence
  Synthetic oligonucleotide
gtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggag

SEQ ID NO: 2374 - DNA, 167 bp, Artificial Sequence
  Synthetic oligonucleotide
gtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccag

SEQ ID NO: 2375 - DNA, 147 bp, Artificial Sequence
  Synthetic oligonucleotide
ggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagca

SEQ ID NO: 2376 - DNA, 5 bp, Artificial Sequence
  Synthetic oligonucleotide
gtggg

SEQ ID NO: 2377 - DNA, 118 bp, Artificial Sequence
  Synthetic oligonucleotide
gtgcgatcctgttcggcaaacattcactcatcctgggctgttctcgccagggctggggacttcgaggcggccgagacgggagttgattctaggcgaaacaagtcatttgaggcctgag

SEQ ID NO: 2378 - DNA, 67 bp, Artificial Sequence
  Synthetic oligonucleotide
gtgtgcacgagccgcccgggactcgcaggccagatgcgtttcttttgtgaggccgagggagaactcg

SEQ ID NO: 2379 - DNA, 64 bp, Artificial Sequence
  Synthetic oligonucleotide
gtcgcagccagggcggcggggcgcgcccagccccggcccctggagcgcccgccgcggtccccac

SEQ ID NO: 2380 - DNA, 35 bp, Artificial Sequence
  Synthetic oligonucleotide
gtctggttcaagaaccggcgagccaagtggcgtaa

SEQ ID NO: 2381 - DNA, 13 bp, Artificial Sequence
  Synthetic oligonucleotide
gcgcgagcgtaac

SEQ ID NO: 2382 - DNA, 3877 bp, Homo sapiens
cgcgccgcagccgcggagggaggggcggggcgggctccggtgtcagcgaccaagccgcaggtggcggcgagcgcggggctcggcccgagctcaggagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggtgaggactgtcctagaggaatcagaagatcccaggggaccctcagggatacttcagggaccccaacccccatgtggctgatcacagcccctgcatctatttctcttcaaacccttttcctgcaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaaggttaggggtcatccagcactgctcctacccactgctatgaactcttatacatgcctaaaaaccccacattccatgccccctcctccaatctagactccctcagctcttgtccctccacctagtccagttctgactctgtggaattgggggcatctgtgtcttgttctgtccccctctactggagctacttgggaccagcactggggctgaattatctcaggggtcctggcatgctcttagcattggagctttcagttcctccttcatcctttctctccttcctctacagggagggactttccccccaccaagcccacactggcaatgactctgtagctcaaacttgcctctctcttcagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccggagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcaggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 2383 - DNA, 3296 bp, Homo sapiens
cgcgccgcagccgcggagggaggggcggggcgggctccggtgtcagcgaccaagccgcaggtggcggcgagcgcggggctcggcccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccggagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcaggcagcctcatccttcctcctggcccaggggtgaggcgtgggaggggtgccctgggtgttgctagagaggctggctggatgcattcgtgtgtgatgttgcccactttgtccacagggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 2384 - DNA, 2040 bp, Homo sapiens
cgcgccgcagccgcggagggaggggcggggcgggctccggtgtcagcgaccaagccgcaggtggcggcgagcgcggggctcggcccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccggagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcaggcagcctcatccttcctcctggcccaggggtgaggcgtgggaggggtgccctgggtgttgctagagaggctggctggatgcattcgtgtgtgatgttgcccactttgtccacagggcaccatgaaacgccattcttcacgtgagtagcctttggtcttcagagtggggaggatcctaaggaagggaggctatgggtttgggcttgaatcataactccgttttgtaactttgggcaggctgcttaaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 2385 - DNA, 125 bp, Artificial Sequence
  Synthetic oligonucleotide
gtgaggactgtcctagaggaatcagaagatcccaggggaccctcagggatacttcagggaccccaacccccatgtggctgatcacagcccctgcatctatttctcttcaaacccttttcctgcag

SEQ ID NO: 2386 - DNA, 359 bp, Artificial Sequence
  Synthetic oligonucleotide
gttaggggtcatccagcactgctcctacccactgctatgaactcttatacatgcctaaaaaccccacattccatgccccctcctccaatctagactccctcagctcttgtccctccacctagtccagttctgactctgtggaattgggggcatctgtgtcttgttctgtccccctctactggagctacttgggaccagcactggggctgaattatctcaggggtcctggcatgctcttagcattggagctttcagttcctccttcatcctttctctccttcctctacagggagggactttccccccaccaagcccacactggcaatgactctgtagctcaaacttgcctctctcttcag

SEQ ID NO: 2387 - DNA, 142 bp, Artificial Sequence
  Synthetic oligonucleotide
gaccttcgccccgctctgggaggtcttccgcgtctcctcggacaagctggcgctgtgccacctggaactgacacggaagttacaggatctcatcaaggacgttctccgctacggcgaggaacagctcaagacccacaagaag

SEQ ID NO: 2388 - DNA, 179 bp, Artificial Sequence
  Synthetic oligonucleotide
gcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcaggcagcctcatccttcctcctggcccaggg

SEQ ID NO: 2389 - DNA, 276 bp, Artificial Sequence
  Synthetic oligonucleotide
gctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggag

SEQ ID NO: 2390 - DNA, 156 bp, Artificial Sequence
  Synthetic oligonucleotide
ctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcag

SEQ ID NO: 2391 - DNA, 133 bp, Artificial Sequence
  Synthetic oligonucleotide
tgacccctcccagagtgaccctgagaccaaagacttctggctcaacatggcagctctgaccgaagccctgcagcgccaggcagagcagaaccccactgcctcctactacaacgtggtgctgctgcgataccag

SEQ ID NO: 2392 - DNA, 200 bp, Artificial Sequence
  Synthetic oligonucleotide
ttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctg

SEQ ID NO: 2393 - DNA, 285 bp, Artificial Sequence
  Synthetic oligonucleotide
ggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgc

SEQ ID NO: 2394 - DNA, 97 bp, Artificial Sequence
  Synthetic oligonucleotide
cgcgccgcagccgcggagggaggggcggggcgggctccggtgtcagcgaccaagccgcaggtggcggcgagcgcggggctcggcccgagctcaggag

SEQ ID NO: 2395 - DNA, 45 bp, Artificial Sequence
  Synthetic oligonucleotide
atggggaaactgaggcacggagctggacagtgactcagacaccag

SEQ ID NO: 2396 - DNA, 105 bp, Artificial Sequence
  Synthetic oligonucleotide
gtgaacactggcttttgagggcagggttgggactcgtgggggcagcaatgccagctgggtcatcacagtgaggagtgagctctgactcccaggagggtacataag

SEQ ID NO: 2397 - DNA, 90 bp, Artificial Sequence
  Synthetic oligonucleotide
gagctgcctggagtggagctgagagctcaggtctgggctcagccagtccagagtgcaaatctactgtcccttcctagctgtgtgatcttg

SEQ ID NO: 2398 - DNA, 77 bp, Artificial Sequence
  Synthetic oligonucleotide
gcaagtgacttcccctctgggggaggggagggctcagttttcccatctgtgaagtggatcagagctttcctgtcaag

SEQ ID NO: 2399 - DNA, 74 bp, Artificial Sequence
  Synthetic oligonucleotide
acaggcactggacggggcctgcaggggtctccacagagaccatcaggatgtcgtattttggggagcatttttgg

SEQ ID NO: 2400 - DNA, 92 bp, Artificial Sequence
  Synthetic oligonucleotide
ggcgagaaaaatcatggctttgaggtcctgtaccacagcgtgaagcaggggcccatctccaccaaggagctggcggacttcatccgggagag

SEQ ID NO: 2401 - DNA, 75 bp, Artificial Sequence
  Synthetic oligonucleotide
ggccaccatcgaggagacctactcgaaggcgatggcgaaactctccaagctggccagcaacgggacccccatggg

SEQ ID NO: 2402 - DNA, 39 bp, Artificial Sequence
  Synthetic oligonucleotide
tgcaaggaggaagtggtgagcaccttggatgctgtgcag

SEQ ID NO: 2403 - DNA, 114 bp, Artificial Sequence
  Synthetic oligonucleotide
gtactctcgggcgtcagccagctcctgcccaagtcccgcgagaactacctgaaccgttgcatggaccaggagcggctgcggagggagagtaccagccagaaggagatggacaag

SEQ ID NO: 2404 - DNA, 105 bp, Artificial Sequence
  Synthetic oligonucleotide
gcggagactaaaaccaagaaggcggcagagagcctgcggcgctcagtggaaaaatacaactcagcccgagctgactttgagcagaagatgctggactcagccctg

SEQ ID NO: 2405 - DNA, 99 bp, Artificial Sequence
  Synthetic oligonucleotide
cgcttccaagccatggaggagacacacctgaggcacatgaaggcactgctgggctcatatgctcactcggtggaggacacgcacgtgcagattgggcag

SEQ ID NO: 2406 - DNA, 97 bp, Artificial Sequence
  Synthetic oligonucleotide
gtgcatgaggaatttaagcagaacatcgagaacgtcagcgtggagatgctactcaggaagtttgcagagagtaagggcacaggccgggagaagcctg

SEQ ID NO: 2407 - DNA, 45 bp, Artificial Sequence
  Synthetic oligonucleotide
gacctctggacttcgaggcatacagtgcggctgccctgcaggaag

SEQ ID NO: 2408 - DNA, 85 bp, Artificial Sequence
  Synthetic oligonucleotide
cgatgaaacgtttgcggggagccaaggcctttcgccttccaggactaagccggcgggagcgggagccggagccacctgcagctgt

SEQ ID NO: 2409 - DNA, 25 bp, Artificial Sequence
  Synthetic oligonucleotide
agatttcctggagcccgattcaggg

SEQ ID NO: 2410 - DNA, 58 bp, Artificial Sequence
  Synthetic oligonucleotide
acatgtccagaggtggatgaagaaggtttcactgtccggcctgatgtgacccagaaca

SEQ ID NO: 2411 - DNA, 85 bp, Artificial Sequence
  Synthetic oligonucleotide
gtgaggcgtgggaggggtgccctgggtgttgctagagaggctggctggatgcattcgtgtgtgatgttgcccactttgtccacag

SEQ ID NO: 2412 - DNA, 25 bp, Artificial Sequence
  Synthetic oligonucleotide
ggcaccatgaaacgccattcttcac

SEQ ID NO: 2413 - DNA, 110 bp, Artificial Sequence
  Synthetic oligonucleotide
gtgagtagcctttggtcttcagagtggggaggatcctaaggaagggaggctatgggtttgggcttgaatcataactccgttttgtaactttgggcaggctgcttaaccac

SEQ ID NO: 2414 - DNA, 52 bp, Artificial Sequence
  Synthetic oligonucleotide
gggacgctgctgggaaaccccagagacctcggtctgcccccagaaccagcag

SEQ ID NO: 2415 - DNA, 92 bp, Artificial Sequence
  Synthetic oligonucleotide
ctgtgcagagagattgcagtcagaggagcaggtgtccaagaacctctttgggccgcccctggagtcagcctttgaccacgaagattttacag

SEQ ID NO: 2416 - DNA, 113 bp, Artificial Sequence
  Synthetic oligonucleotide
acctgatgcctgcacctgctgaccccacagccagggagggcctggcagccccacccaggagacttcgctctaggaaggtgtcctgccctctcacacgtagcaatggggacctg

SEQ ID NO: 2417 - DNA, 88 bp, Artificial Sequence
  Synthetic oligonucleotide
tctcgttccctgagcccctccccactgggctcttcagccgccagcactgccttggaacggcccagcttcttatcccagacaggacacg

SEQ ID NO: 2418 - DNA, 109 bp, Artificial Sequence
  Synthetic oligonucleotide
gagtctcccggggtccgagccctgtggtcctgggctcccaggatgccctgcccatagccacagccttcacggagtatgtccacgcctacttccgtggccacagccccag

SEQ ID NO: 2419 - DNA, 56 bp, Artificial Sequence
  Synthetic oligonucleotide
gaacctggaggagaagcggctcacttggaggcttccagatgtgtccgaggcaggcg

SEQ ID NO: 2420 - DNA, 91 bp, Artificial Sequence
  Synthetic oligonucleotide
gttctggccgcctctctgccagctgggagccgctctcagggcccagcacacccagccccgtggctgcacagttcaccagcgaggggaccac

SEQ ID NO: 2421 - DNA, 74 bp, Artificial Sequence
  Synthetic oligonucleotide
tctgtcgggcgtggacttggaactggtgggcagcggttaccgcatgtcgctggtgaagaggaggtttgccacag

SEQ ID NO: 2422 - DNA, 2075 bp, Homo sapiens
aatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2423 - DNA, 1790 bp, Homo sapiens
acatacagtcagcatgactgtatagcagcggtggcactgctattcttccatctgggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2424 - DNA, 1917 bp, Homo sapiens
acatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctgggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2425 - DNA, 1833 bp, Homo sapiens
aatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2426 - DNA, 1859 bp, Homo sapiens
aaggggtacacttaattttaaacaatactataggaaggacttgtgtctattttaaatttgtttcttgacatactttccagaaactttttctgatagttcgattcatttgctgcactttccggaactctaaggcatttctgtgaagtccacttgaagatcttcaaaatgagctgctccagaggcttctattccccgaggtacagaggggccttgcttcgcattgtgctgtccacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2427 - DNA, 1917 bp, Homo sapiens
aaggggtacacttaattttaaacaatactataggaaggacttgtgtctattttaaatttgtttcttgacatactttccagaaactttttctgatagttcgattcatttgctgcactttccggaactctaaggcatttctgtgaagtccacttgaagatcttcaaaatgagctgctccagaggcttctattccccgaggtacagaggggccttgcttcgcattgtgctgtccacagaataagttggcaccagatcaagcatttgaaggagtagcagggctgtgactgatgtctggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2428 - DNA, 1954 bp, Homo sapiens
aaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2429 - DNA, 131 bp, Artificial Sequence
  Synthetic oligonucleotide
aaggggtacacttaattttaaacaatactataggaaggacttgtgtctattttaaatttgtttcttgacatactttccagaaactttttctgatagttcgattcatttgctgcactttccggaactctaag

SEQ ID NO: 2430 - DNA, 199 bp, Artificial Sequence
  Synthetic oligonucleotide
gttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttaga

SEQ ID NO: 2431 - DNA, 209 bp, Artificial Sequence
  Synthetic oligonucleotide
aatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttg

SEQ ID NO: 2432 - DNA, 130 bp, Artificial Sequence
  Synthetic oligonucleotide
gtgagtctgtgtggtcagcagtctctgatccgtgcagggtattaatgtgtcagggctgagtgttctgagatttatctagaggctgggaagggctcctgaaccagttgtttccgtcttgtcggtctgtcag

SEQ ID NO: 2433 - DNA, 198 bp, Artificial Sequence
  Synthetic oligonucleotide
gttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcag

SEQ ID NO: 2434 - DNA, 231 bp, Artificial Sequence
  Synthetic oligonucleotide
gtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggag

SEQ ID NO: 2435 - DNA, 134 bp, Artificial Sequence
  Synthetic oligonucleotide
gtaattgatctgggtggtgagccaattaaaagcagtgactactttggtaatggccgggtgacagaattcaagtatggtgcaaaactcggcacagttattcgcaagtggaatggagagaagatgtcttacttaaa

SEQ ID NO: 2436 - DNA, 123 bp, Artificial Sequence
  Synthetic oligonucleotide
gaactggggagaaggttggggtttcatgccttctgacagagcgcttgtctttgtggataaccatgacaatcaacgaggacatggcgctggaggagcctctatacttaccttctgggatgctag

SEQ ID NO: 2437 - DNA, 126 bp, Artificial Sequence
  Synthetic oligonucleotide
gaacatggttaatttccgcaatgtagtggatggccagccttttacaaactggtatgataatgggagcaaccaagtggcttttgggagaggaaacagaggattcattgttttcaacaatgatgactg

SEQ ID NO: 2438 - DNA, 232 bp, Artificial Sequence
  Synthetic oligonucleotide
gacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaagtg

SEQ ID NO: 2439 - DNA, 104 bp, Artificial Sequence
  Synthetic oligonucleotide
gcatttctgtgaagtccacttgaagatcttcaaaatgagctgctccagaggcttctattccccgaggtacagaggggccttgcttcgcattgtgctgtccacag

SEQ ID NO: 2440 - DNA, 54 bp, Artificial Sequence
  Synthetic oligonucleotide
acatacagtcagcatgactgtatagcagcggtggcactgctattcttccatctg

SEQ ID NO: 2441 - DNA, 69 bp, Artificial Sequence
  Synthetic oligonucleotide
gtaactttatgtatctttcctttattgtttgtcctctctctgtctgaaaaaattctttttcctctttag

SEQ ID NO: 2442 - DNA, 58 bp, Artificial Sequence
  Synthetic oligonucleotide
aataagttggcaccagatcaagcatttgaaggagtagcagggctgtgactgatgtctg

SEQ ID NO: 2443 - DNA, 112 bp, Artificial Sequence
  Synthetic oligonucleotide
ggttggaaagtccaagccataggacccagtttcctttcttagcttacgttatctaccagagcaccgtgggctgttacttgccttgagttggaagcggttcgcatttataccg

SEQ ID NO: 2444 - DNA, 109 bp, Artificial Sequence
  Synthetic oligonucleotide
gaatataaatagtttctggaaaggacactgacaacttcaaagcaaaatgaagctcttttggttgcttttcaccattgggttctgctgggctcagtattcctcaaataca

SEQ ID NO: 2445 - DNA, 105 bp, Artificial Sequence
  Synthetic oligonucleotide
caacaaggacgaacatctattgttcatctgtttgaatggcgatgggttgatattgctcttgaatgtgagcgatatttagctcccaagggatttggaggggttcag

SEQ ID NO: 2446 - DNA, 33 bp, Artificial Sequence
  Synthetic oligonucleotide
gtctctccaccaaatgaaaatgttgccattcac

SEQ ID NO: 2447 - DNA, 114 bp, Artificial Sequence
  Synthetic oligonucleotide
aaccctttcagaccttggtgggaaagataccaaccagttagctataaattatgcacaagatctggaaatgaagatgaatttagaaacatggtgactagatgcaacaatgttggg

SEQ ID NO: 2448 - DNA, 100 bp, Artificial Sequence
  Synthetic oligonucleotide
gctgtacaaaatggcagttggatttatgcttgctcatccttatggatttacacgagtaatgtcaagctaccgttggccaagatattttgaaaatggaaaa

SEQ ID NO: 2449 - DNA, 119 bp, Artificial Sequence
  Synthetic oligonucleotide
gatgttaatgattgggttgggccaccaaatgataatggagtaactaaagaagttactattaatccagacactacttgtggcaatgactgggtctgtgaacatcgatggcgccaaataag

SEQ ID NO: 2450 - DNA, 5614 bp, Homo sapiens
gaacaccccagcaggtgtcagggacagggcagtattccagcttcagcctgtctacctctggagctctcctgatcaatacatcagagaagatgatggagccctcctgccgctcttggggagagttgcgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgtgaacgggtggagccggctggaacttaacgctgtcgaccctcagagtcccacccggtggcctccaagccccgctccaggatccctccttccggccccaggattccccggcccccctaggaccaggggccaggggccaggggccagggtcctgcagccctacctctaggtcctccaggaccaccccgacggtctccagacccatcccccaaagtctcccagtcaattcagcccccaggattccttgccctgctctcagagtcttccacttcctctccaaaattcctagaccacaccccagggtcctccaacctcgccccctgagtcctccagcccagtttcccagtctgctccctttagggcctccttcagggtttctcccagttccacccctttcccacctcctagcttcaggatcccctatcctccaccttaggggcccaaagccttgcacccagtgcccttccctagtcctgccccatgatttctccaacccaccagatgctcacagctcagcccttatttccaagtgttccagcctggacgcttccccacagccctccaattctctctcttcctggggcccctaagcctggaagcagttggttagggctgaacaagacagagacggtgaccccaagtggggttgcttacctgagctgtctccttccagaacatctgctaaagctgcaggagcctgggccaggaccagggctgccagcaggggcaggaacagctgggccatgctgcaggctgacagagggacatgagaaggaaagatggggttagacttcaggatggacttcccccctgctccctaccacacccatgtgggttcacacatatcctggctccagaagtcccctaccttcacatcaccatggactctctgtttctgatccccatcttcccagcaagtgatttcttctcagaaccaaaacccgagtcctagtcaactcactgtgtgacctaagccaagctccttaccttctctgagcctttattttcttacttataaaaaagcatcatcattactatctcatgagttgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcctctctttactccccaacattctccatcccccttccttggctgcctcctcccttcttcttcccagcctctcctttctgcctggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcagagaaggatagggctgaccctggatccctagtaaagccaagtcaggcacgagggcaatgtgctcccaggagagaagactcagagctacatcatctttaagggttgggctaaacttagaagagcatggagatccaggtatgccatggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccagacattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcggaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgaccctggatgtccatctccctcacagtcttcatagacccaacccagagagttaagaccaggtctctctctctctctctctctctctctctctctctctctgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaaggtcacagagcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggaggcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactc

SEQ ID NO: 2451 - DNA, 5593 bp, Homo sapiens
gaacaccccagcaggtgtcagggacagggcagtattccagcttcagcctgtctacctctggagctctcctgatcaatacatcagagaagatgatggagccctcctgccgctcttggggagagttgcgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgtgaacgggtggagccggctggaacttaacgctgtcgaccctccaagccccgctccaggatccctccttccggccccaggattccccggcccccctaggaccaggggccaggggccaggggccagggtcctgcagccctacctctaggtcctccaggaccaccccgacggtctccagacccatcccccaaagtctcccagtcaattcagcccccaggattccttgccctgctctcagagtcttccacttcctctccaaaattcctagaccacaccccagggtcctccaacctcgccccctgagtcctccagcccagtttcccagtctgctccctttagggcctccttcagggtttctcccagttccacccctttcccacctcctagcttcaggatcccctatcctccaccttaggggcccaaagccttgcacccagtgcccttccctagtcctgccccatgatttctccaacccaccagatgctcacagctcagcccttatttccaagtgttccagcctggacgcttccccacagccctccaattctctctcttcctggggcccctaagcctggaagcagttggttagggctgaacaagacagagacggtgaccccaagtggggttgcttacctgagctgtctccttccagaacatctgctaaagctgcaggagcctgggccaggaccagggctgccagcaggggcaggaacagctgggccatgctgcaggctgacagagggacatgagaaggaaagatggggttagacttcaggatggacttcccccctgctccctaccacacccatgtgggttcacacatatcctggctccagaagtcccctaccttcacatcaccatggactctctgtttctgatccccatcttcccagcaagtgatttcttctcagaaccaaaacccgagtcctagtcaactcactgtgtgacctaagccaagctccttaccttctctgagcctttattttcttacttataaaaaagcatcatcattactatctcatgagttgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcctctctttactccccaacattctccatcccccttccttggctgcctcctcccttcttcttcccagcctctcctttctgcctggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcagagaaggatagggctgaccctggatccctagtaaagccaagtcaggcacgagggcaatgtgctcccaggagagaagactcagagctacatcatctttaagggttgggctaaacttagaagagcatggagatccaggtatgccatggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccagacattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcggaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgaccctggatgtccatctccctcacagtcttcatagacccaacccagagagttaagaccaggtctctctctctctctctctctctctctctctctctctctgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaaggtcacagagcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggaggcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactc

SEQ ID NO: 2452 - DNA, 5924 bp, Homo sapiens
gaacaccccagcaggtgtcagggacagggcagtattccagcttcagcctgtctacctctggagctctcctgatcaatacatcagagaagatgatggagccctcctgccgctcttggggagagttgcgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgtgaacgggtggagccggctggaacttaacgctgtcgaccctcagagtcccacccggtggcctccaagccccgctccaggatccctccttccggccccaggattccccggcccccctaggaccaggggccaggggccaggggccagggtcctgcagccctacctctaggtcctccaggaccaccccgacggtctccagacccatcccccaaagtctcccagtcaattcagcccccaggattccttgccctgctctcagagtcttccacttcctctccaaaattcctagaccacaccccagggtcctccaacctcgccccctgagtcctccagcccagtttcccagtctgctccctttagggcctccttcagggtttctcccagttccacccctttcccacctcctagcttcaggatcccctatcctccaccttaggggcccaaagccttgcacccagtgcccttccctagtcctgccccatgatttctccaacccaccagatgctcacagctcagcccttatttccaagtgttccagcctggacgcttccccacagccctccaattctctctcttcctggggcccctaagcctggaagcagttggttagggctgaacaagacagagacggtgaccccaagtggggttgcttacctgagctgtctccttccagaacatctgctaaagctgcaggagcctgggccaggaccagggctgccagcaggggcaggaacagctgggccatgctgcaggctgacagagggacatgagaaggaaagatggggttagacttcaggatggacttcccccctgctccctaccacacccatgtgggttcacacatatcctggctccagaagtcccctaccttcacatcaccatggactctctgtttctgatccccatcttcccagcaagtgatttcttctcagaaccaaaacccgagtcctagtcaactcactgtgtgacctaagccaagctccttaccttctctgagcctttattttcttacttataaaaaagcatcatcattactatctcatgagttgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcctctctttactccccaacattctccatcccccttccttggctgcctcctcccttcttcttcccagcctctcctttctgcctggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcagagaaggatagggctgaccctggatccctagtaaagccaagtcaggcacgagggcaatgtgctcccaggagagaagactcagagctacatcatctttaagggttgggctaaacttagaagagcatggagatccaggtatgccatggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccagacattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcggaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgaccctggatgtccatctccctcacagtcttcatagacccaacccagagagttaagaccaggtctctctctctctctctctctctctctctctctctctctgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaaggtcacagagcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggaggcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactcttttctggaggcagaatggggtgcaaaggaccgtagctacctccctggaggcagctatgattgggcattggctcctgtggtgctcccactccctgcacagaggaggagctgactttgcagctggaaggatggaggttagacagcagaatcatgggttaagcaaagcaattcaggaaatctctagacctggggtgggggtggggtgagggtggccctgtgaagggacattaccagtcatgcaaaccaatgtgcaaaatgcaggcgttgctgggagcccagaaggcctactggccagggctgtcgatgctga

SEQ ID NO: 2453 - DNA, 5461 bp, Homo sapiens
gaacaccccagcaggtgtcagggacagggcagtattccagcttcagcctgtctacctctggagctctcctgatcaatacatcagagaagatgatggagccctcctgccgctcttggggagagttgcgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgtgaacgggtggagccggctggaacttaacgctgtcgaccctcagagtcccacccggtggcctccaagccccgctccaggatccctccttccggccccaggattccccggcccccctaggaccaggggccaggggccaggggccagggtcctgcagccctacctctaggtcctccaggaccaccccgacggtctccagacccatcccccaaagtctcccagtcaattcagcccccaggattccttgccctgctctcagagtcttccacttcctctccaaaattcctagaccacaccccagggtcctccaacctcgccccctgagtcctccagcccagtttcccagtctgctccctttagggcctccttcagggtttctcccagttccacccctttcccacctcctagcttcaggatcccctatcctccaccttaggggcccaaagccttgcacccagtgcccttccctagtcctgccccatgatttctccaacccaccagatgctcacagctcagcccttatttccaagtgttccagcctggacgcttccccacagccctccaattctctctcttcctggggcccctaagcctggaagcagttggttagggctgaacaagacagagacggtgaccccaagtggggttgcttacctgagctgtctccttccagaacatctgctaaagctgcaggagcctgggccaggaccagggctgccagcaggggcaggaacagctgggccatgctgcaggctgacagagggacatgagaaggaaagatggggttagacttcaggatggacttcccccctgctccctaccacacccatgtgggttcacacatatcctggctccagaagtcccctaccttcacatcaccatggactctctgtttctgatccccatcttcccagcaagtgatttcttctcagaaccaaaacccgagtcctagtcaactcactgtgtgacctaagccaagctccttaccttctctgagcctttattttcttacttataaaaaagcatcatcattactatctcatgagttgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcctctctttactccccaacattctccatcccccttccttggctgcctcctcccttcttcttcccagcctctcctttctgcctggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcagagaaggatagggctgaccctggatccctagtaaagccaagtcaggcacgagggcaatgtgctcccaggagagaagactcagagctacatcatctttaagggttgggctaaacttagaagagcatggagatccaggtatgccatggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccagacattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcggaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgaccctggatgtccatctccctcacagtcttcatagacccaacccagagagttaagaccaggtctctctctctctctctctctctctctctctctctctctgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaaggtcacagagcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactc

SEQ ID NO: 2454 - DNA, 1261 bp, Homo sapiens
gaacaccccagcaggtgtcagggacagggcagtattccagcttcagcctgtctacctctggagctctcctgatcaatacatcagagaagatgatggagccctcctgccgctcttggggagagttggtcacagagcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggaggcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactc

SEQ ID NO: 2455 - DNA, 125 bp, Artificial Sequence
  Synthetic oligonucleotide
gaacaccccagcaggtgtcagggacagggcagtattccagcttcagcctgtctacctctggagctctcctgatcaatacatcagagaagatgatggagccctcctgccgctcttggggagagttg

SEQ ID NO: 2456 - DNA, 396 bp, Artificial Sequence
  Synthetic oligonucleotide
cgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgtgaacgggtggagccggctggaacttaacgctgtcgacc

SEQ ID NO: 2457 - DNA, 3936 bp, Artificial Sequence
  Synthetic oligonucleotide
ctccaagccccgctccaggatccctccttccggccccaggattccccggcccccctaggaccaggggccaggggccaggggccagggtcctgcagccctacctctaggtcctccaggaccaccccgacggtctccagacccatcccccaaagtctcccagtcaattcagcccccaggattccttgccctgctctcagagtcttccacttcctctccaaaattcctagaccacaccccagggtcctccaacctcgccccctgagtcctccagcccagtttcccagtctgctccctttagggcctccttcagggtttctcccagttccacccctttcccacctcctagcttcaggatcccctatcctccaccttaggggcccaaagccttgcacccagtgcccttccctagtcctgccccatgatttctccaacccaccagatgctcacagctcagcccttatttccaagtgttccagcctggacgcttccccacagccctccaattctctctcttcctggggcccctaagcctggaagcagttggttagggctgaacaagacagagacggtgaccccaagtggggttgcttacctgagctgtctccttccagaacatctgctaaagctgcaggagcctgggccaggaccagggctgccagcaggggcaggaacagctgggccatgctgcaggctgacagagggacatgagaaggaaagatggggttagacttcaggatggacttcccccctgctccctaccacacccatgtgggttcacacatatcctggctccagaagtcccctaccttcacatcaccatggactctctgtttctgatccccatcttcccagcaagtgatttcttctcagaaccaaaacccgagtcctagtcaactcactgtgtgacctaagccaagctccttaccttctctgagcctttattttcttacttataaaaaagcatcatcattactatctcatgagttgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcctctctttactccccaacattctccatcccccttccttggctgcctcctcccttcttcttcccagcctctcctttctgcctggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcagagaaggatagggctgaccctggatccctagtaaagccaagtcaggcacgagggcaatgtgctcccaggagagaagactcagagctacatcatctttaagggttgggctaaacttagaagagcatggagatccaggtatgccatggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccagacattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcggaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgaccctggatgtccatctccctcacagtcttcatagacccaacccagagagttaagaccaggtctctctctctctctctctctctctctctctctctctctgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaag

SEQ ID NO: 2458 - DNA, 153 bp, Artificial Sequence
  Synthetic oligonucleotide
gcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggag

SEQ ID NO: 2459 - DNA, 1285 bp, Artificial Sequence
  Synthetic oligonucleotide
gcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactcttttctggaggcagaatggggtgcaaaggaccgtagctacctccctggaggcagctatgattgggcattggctcctgtggtgctcccactccctgcacagaggaggagctgactttgcagctggaaggatggaggttagacagcagaatcatgggttaagcaaagcaattcaggaaatctctagacctggggtgggggtggggtgagggtggccctgtgaagggacattaccagtcatgcaaaccaatgtgcaaaatgcaggcgttgctgggagcccagaaggcctactggccagggctgtcgatgctga

SEQ ID NO: 2460 - DNA, 21 bp, Artificial Sequence
  Synthetic oligonucleotide
ctcagagtcccacccggtggc

SEQ ID NO: 2461 - DNA, 8 bp, Artificial Sequence
  Synthetic oligonucleotide
gtcacaga

SEQ ID NO: 2462 - DNA, 1709 bp, Homo sapiens
tagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2463 - DNA, 1697 bp, Homo sapiens
tagcacagccatgcccaggccaggacccgtgacacagcgatgctctcagatgctgctgatgttacagatgttgttgggggcacccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2464 - DNA, 1385 bp, Homo sapiens
tagcacagccatgcccaggccaggacccgtgacacagcgatgctctcagatgctgctgatgttacagatgttgttgggggcacccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2465 - DNA, 1614 bp, Homo sapiens
tagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2466 - DNA, 3138 bp, Homo sapiens
tagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaaacaatgggggtgtggtgcatggatagaagtttgtgatgggcagagccagctggagctggttctgaatctgatgaaatcgcttgtcaaggcactgctaaagtcacatgcaacgagcgacttgttaggggaggaggagagtattttccccatctctgtgccctccatggaggctccaggggtgcagggcactggatgaggtctgggctgtggtgggacccaggagggggcaggcagaggggcacactcttagcccgccctaaacccatctgtgccgtgtgactccggcaaacctctcacccttgctaagcctagcaactaggttaaggcaccctcaaaccccagtctccccagtctccctaacacttgtaccagcctgaggggctgtgattcctagaggctcagtagtctggaatgtgatgggtttggcactcttcatttctcgggattacacctgtaatcccagcactttaggaggccaaggtgggagcatcgctttaggccagaacattgcagcctgggcagtatagcgagaatccatctctaccaaaaatgtttaaaaaaaattagccagacatgatggtgtgtgcctgtagtctcagttattcaggaggctgaggcgggaggagcacttgaatccaggagattgaggctgcactgagccatgagtgcagtggcacgatcttggctcactgcaacctccaccgccccgattcaagccattcttctgcctcagcctcccgagtagctgggatcacaggcgccagccaccatgcccagctaatttttggtatttttagtagaagcgggcgtttcaccatattggccacatatcggccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2467 - DNA, 2257 bp, Homo sapiens
tagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaaacaatgggggtgtggtgcatggatagaagtttgtgatgggcagagccagctggagctggttctgaatctgatgaaatcgcttgtcaaggcactgctaaagtcacatgcaacgagcgacttgttaggggaggaggagagtattttccccatctctgtgccctccatggaggctccaggggtgcagggcactggatgagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2468 - DNA, 1547 bp, Homo sapiens
tagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 2469 - DNA, 312 bp, Artificial Sequence
  Synthetic oligonucleotide
actcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcag

SEQ ID NO: 2470 - DNA, 238 bp, Artificial Sequence
  Synthetic oligonucleotide
atgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaag

SEQ ID NO: 2471 - DNA, 548 bp, Artificial Sequence
  Synthetic oligonucleotide
gtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaaacaatgggggtgtggtgcatggatagaagtttgtgatgggcagagccagctggagctggttctgaatctgatgaaatcgcttgtcaaggcactgctaaagtcacatgcaacgagcgacttgttaggggaggaggagagtattttccccatctctgtgccctccatggaggctccaggggtgcagggcactggatgag

SEQ ID NO: 2472 - DNA, 254 bp, Artificial Sequence
  Synthetic oligonucleotide
gtctgggctgtggtgggacccaggagggggcaggcagaggggcacactcttagcccgccctaaacccatctgtgccgtgtgactccggcaaacctctcacccttgctaagcctagcaactaggttaaggcaccctcaaaccccagtctccccagtctccctaacacttgtaccagcctgaggggctgtgattcctagaggctcagtagtctggaatgtgatgggtttggcactcttcatttctcgggattacac

SEQ ID NO: 2473 - DNA, 212 bp, Artificial Sequence
  Synthetic oligonucleotide
ctgtaatcccagcactttaggaggccaaggtgggagcatcgctttaggccagaacattgcagcctgggcagtatagcgagaatccatctctaccaaaaatgtttaaaaaaaattagccagacatgatggtgtgtgcctgtagtctcagttattcaggaggctgaggcgggaggagcacttgaatccaggagattgaggctgcactgagccat

SEQ ID NO: 2474 - DNA, 160 bp, Artificial Sequence
  Synthetic oligonucleotide
ctgggatcacaggcgccagccaccatgcccagctaatttttggtatttttagtagaagcgggcgtttcaccatattggccacatatcggccaggctggtcttgaactcctgacctcaagtgatccacctgcatcggcctcccaaagtgctgggattacag

SEQ ID NO: 2475 - DNA, 173 bp, Artificial Sequence
  Synthetic oligonucleotide
gcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacag

SEQ ID NO: 2476 - DNA, 120 bp, Artificial Sequence
  Synthetic oligonucleotide
ctggagttgcacttgcggccgcaagccgccagggggcgccgcagagcgcgtgcgcgcaacggggaccactgtccgctcgggcccgggcgttgctgccgtctgcacacggtccgcgcgtcg

SEQ ID NO: 2477 - DNA, 159 bp, Artificial Sequence
  Synthetic oligonucleotide
gtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtc

SEQ ID NO: 2478 - DNA, 84 bp, Artificial Sequence
  Synthetic oligonucleotide
tagcacagccatgcccaggccaggacccgtgacacagcgatgctctcagatgctgctgatgttacagatgttgttgggggcacc

SEQ ID NO: 2479 - DNA, 12 bp, Artificial Sequence
  Synthetic oligonucleotide
ctgagggggcac

SEQ ID NO: 2480 - DNA, 74 bp, Artificial Sequence
  Synthetic oligonucleotide
cctgactctgcaggtgagaaccttctggggttcctaggaccctcggacaagcactctgatccggatgactccag

SEQ ID NO: 2481 - DNA, 98 bp, Artificial Sequence
  Synthetic oligonucleotide
gtcccaggagttgcagaaacgccaccaggaccttcagagcaccagttagacaaggagagccaggaggagctgggccccaacctcatccaaaagcacag

SEQ ID NO: 2482 - DNA, 82 bp, Artificial Sequence
  Synthetic oligonucleotide
gagtgcagtggcacgatcttggctcactgcaacctccaccgccccgattcaagccattcttctgcctcagcctcccgagtag

SEQ ID NO: 2483 - DNA, 29 bp, Artificial Sequence
  Synthetic oligonucleotide
tgcggctgggatccggcggccacctgcac

SEQ ID NO: 2484 - DNA, 21 bp, Artificial Sequence
  Synthetic oligonucleotide
ctgcgtatctctcgggccgcc

SEQ ID NO: 2485 - DNA, 51 bp, Artificial Sequence
  Synthetic oligonucleotide
cttcccgaggggctccccgaggcctcccgccttcaccgggctctgttccgg

SEQ ID NO: 2486 - DNA, 90 bp, Artificial Sequence
  Synthetic oligonucleotide
ctgtccccgacggcgtcaaggtcgtgggacgtgacacgaccgctgcggcgtcagctcagccttgcaagaccccaggcgcccgcgctgcac

SEQ ID NO: 2487 - DNA, 37 bp, Artificial Sequence
  Synthetic oligonucleotide
ctgcgactgtcgccgccgccgtcgcagtcggaccaac

SEQ ID NO: 2488 - DNA, 32 bp, Artificial Sequence
  Synthetic oligonucleotide
tgctggcagaatcttcgtccgcacggccccag

SEQ ID NO: 2489 - DNA, 17 bp, Artificial Sequence
  Synthetic oligonucleotide
ctggaagacctgggctg

SEQ ID NO: 2490 - DNA, 17 bp, Artificial Sequence
  Synthetic oligonucleotide
ggccgattgggtgctgt

SEQ ID NO: 2491 - DNA, 11 bp, Artificial Sequence
  Synthetic oligonucleotide
cgccacgggag

SEQ ID NO: 2492 - DNA, 14 bp, Artificial Sequence
  Synthetic oligonucleotide
gtgcaagtgaccat

SEQ ID NO: 2493 - DNA, 46 bp, Artificial Sequence
  Synthetic oligonucleotide
gtgcatcggcgcgtgcccgagccagttccgggcggcaaacatgcac

SEQ ID NO: 2494 - DNA, 24 bp, Artificial Sequence
  Synthetic oligonucleotide
gcgcagatcaagacgagcctgcac

SEQ ID NO: 2495 - DNA, 25 bp, Artificial Sequence
  Synthetic oligonucleotide
cgcctgaagcccgacacggtgccag

SEQ ID NO: 2496 - DNA, 11 bp, Artificial Sequence
  Synthetic oligonucleotide
cgccctgctgc

SEQ ID NO: 2497 - DNA, 69 bp, Artificial Sequence
  Synthetic oligonucleotide
ctgccctgtggaatgggctcaaggttcctgagacacccgattcctgcccaaacagctgtatttatataa

SEQ ID NO: 2498 - DNA, 20 bp, Artificial Sequence
  Synthetic oligonucleotide
gtctgttatttattattaat

SEQ ID NO: 2499 - DNA, 98 bp, Artificial Sequence
  Synthetic oligonucleotide
ttattggggtgaccttcttggggactcgggggctggtctgatggaactgtgtatttatttaaaactctggtgataaaaataaagctgtctgaactgtt

SEQ ID NO: 2500 - DNA, 1537 bp, Homo sapiens
tttatttcatatgttgtctcccctccttgactgtcttcatgaatccaaataacctcccagattatgtctatttattcagcatgtcctcttaatccttttacctgcagtataaagcaacaccaaaatatataaaataataaaactatagtgcaaagtaaggaaatgattgctggaaaaatcagaatggtcatcatttctaggtgggaaagagaattgtgatttggaatggacacatggtgactacaaagatgcagctctgttctgtttcttggaaacacgagtgtttgctttataattatttattaactatagatttgtatcttttgagcttttctgaatatatgctgtatttcacaataaagatgttcaaaaaattaaatgaaaactctgatattttaaatgcgagaagtgaggcatatcggttaacttctttgtttttgtaggcaggtgttattgcactgtttgtatgattcagacccacctactctgctggaaacaagcagaaattcaacccacgtttaccatgtaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 2501 - DNA, 1207 bp, Homo sapiens
atccagccttgggctcccaaaagtgttgggagtataggtgtaagccaccatgtccagctttttgtttgtttttttgagaaagttttttgattgaagatacaaaatttcttaaactcctgggacactgataaattcctcatttaaaaatgaggaaagataagcaaatttaaacataaaagataagtaaatcaccctttagaataagtactgctttggcaagatttggttttcttagaatagctttaggaattttgcttaaccctattgcttttagcagtttgtttttcatttcaatatctgttttattctctgcagttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 2502 - DNA, 1623 bp, Homo sapiens
gatagtgctggatagtcttttatttttctcactttgattttcttactgaccataaatcaacaaatcagcctgtagatgttaattgaacattgccaggtcctaggtaatttgctatttaaatttattttattttatttttgagacagggtctcactatgtctccagggcttggagtgcatgagcccagactgtgccactacactccaacctgagcgacagagtgagaccctatctcaaaaaacaaaatgaaacaaaaagtttctcttattctggtgattttttttttattagttgtcttgcttcccttttccatatttgtattttccagatttggggttattaccttagcaggttttatataatttaaattactggattcaacattataaatgtgaagatggctaagtcatgatggccatattttgtcaaaatgctatttatatgtgaaaatgttggttttacttgacgcttattattgggtattataatttttatgtcaaagttcaggtaataaattgtgtcttactttgatttgcatttttaaattaatgagattgaaatatttggatgtcgtatgttaatttgtttcctaccttttaataatttatccattttgattatttgtatgaatttcttgggtaataatgtatcttttccatatttatcgcatgtatttttttcccattctttgctgttgtttctgttttttggagcaagggacatcgatatttcttaacttttaagtggtgggaacatcaaagaaaggtgggctgagaatacacgagtgctatgtcatgcaaattcttatgtcatatttaggggatttagacttcatcttgaaaaagctgaggaactactaaagattttttacttttaagcaccaagtgatacgatcagtttagaaagattactccaaaagcaatagagaggaaggagtagagagagttgaggctggagggcaggagatcaactaacaggctcttgtggttggtaatcttcaagaataatctgaaaaatgatggcagcctaaacaatggaagtttgaatggagaggagggatgggggtaagagagatttggtagaatagaattgagcacttgccgggaggagtcagcaggaggggagaaggaaaagtcttggctgtgttccaagtttgtagtctgtgtagcagggtggatggtggtgcccttcactaaagtaaagacgacagtggagaacatgtttgggttacataagcctccttgatgttggtgggttcaggtgggacatttgaaatgcctatgaagtcaggagggaattgaatatcctgatttgtttttattcactagttaaagcttgaaaaattttccttttttgacattaaatcttgttgttgttttaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 2503 - DNA, 547 bp, Homo sapiens
cctccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagattttcctgtcaacgggaccaatatcactgatggggaaatgaggcaacttgaaagctaggagtcaagttcaactgctttctcctttatcctcacactggattattttgctttcaccttgagagtcttcctcagcttcatccttttccatgcctgagggccctcctcc

SEQ ID NO: 2504 - DNA, 741 bp, Homo sapiens
ggttcatctgtgcctcaaacctcggcatcatgtaatatacctttataacaaacctgcacatttagactcccctgagtctacaataaaagttgagggaaaaaaagatgactactggaaaattcataatagtattgggagtaacaattctaagaggaaaaaaataagctctgaatttatagtactcctttctgttatgaagtagataacatctatattaagccaaaatcagattcttgggaatagtcagtaggtttttatggttcttcaaatgacatcacatttcctaccattagaatcagatttcaaaataggaactttttcaggaaaatgaaggacagaatgtgggaacagactgtaaagaagaggcggggggagaagtactagctcaagagtaaaacggaatgggaaagcatagtcatttccttgagaatgatttagaagactgcttaggaagtactgttactatcatctggagatctgccagcatttcttttccattggaccatttagaaaccacaggtagagcaatcagtaccttaaagcacgtttttctcttctgtgtttgatttttgtttgtttgtttgactcacaggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgaca

SEQ ID NO: 2505 - DNA, 773 bp, Homo sapiens
ggttcatctgtgcctcaaacctcggcatcatgtaatatacctttataacaaacctgcacatttagactcccctgagtctacaataaaagttgagggaaaaaaagatgactactggaaaattcataatagtattgggagtaacaattctaagaggaaaaaaataagctctgaatttatagtactcctttctgttatgaagtagataacatctatattaagccaaaatcagattcttgggaatagtcagtaggtttttatggttcttcaaatgacatcacatttcctaccattagaatcagatttcaaaataggaactttttcaggaaaatgaaggacagaatgtgggaacagactgtaaagaagaggcggggggagaagtactagctcaagagtaaaacggaatgggaaagcatagtcatttccttgagaatgatttagaagactgcttaggaagtactgttactatcatctggagatctgccagcatttcttttccattggaccatttagaaaccacaggtagagcaatcagtaccttaaagcacgtttttctcttctgtgtttgatttttgtttgtttgtttgactcacaggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgacaaaaaaaaatgacttattggaaatattaactaa

SEQ ID NO: 2506 - DNA, 183 bp, Artificial Sequence
  Synthetic oligonucleotide
cctccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccag

SEQ ID NO: 2507 - DNA, 178 bp, Artificial Sequence
  Synthetic oligonucleotide
gatagtgctggatagtcttttatttttctcactttgattttcttactgaccataaatcaacaaatcagcctgtagatgttaattgaacattgccaggtcctaggtaatttgctatttaaatttattttattttatttttgagacagggtctcactatgtctccagggcttggagtgca

SEQ ID NO: 2508 - DNA, 166 bp, Artificial Sequence
  Synthetic oligonucleotide
ttttcctgtcaacgggaccaatatcactgatggggaaatgaggcaacttgaaagctaggagtcaagttcaactgctttctcctttatcctcacactggattattttgctttcaccttgagagtcttcctcagcttcatccttttccatgcctgagggccctcctcc

SEQ ID NO: 2509 - DNA, 443 bp, Artificial Sequence
  Synthetic oligonucleotide
tttatttcatatgttgtctcccctccttgactgtcttcatgaatccaaataacctcccagattatgtctatttattcagcatgtcctcttaatccttttacctgcagtataaagcaacaccaaaatatataaaataataaaactatagtgcaaagtaaggaaatgattgctggaaaaatcagaatggtcatcatttctaggtgggaaagagaattgtgatttggaatggacacatggtgactacaaagatgcagctctgttctgtttcttggaaacacgagtgtttgctttataattatttattaactatagatttgtatcttttgagcttttctgaatatatgctgtatttcacaataaagatgttcaaaaaattaaatgaaaactctgatattttaaatgcgagaagtgaggcatatcggttaacttctttgtttttgtag

SEQ ID NO: 2510 - DNA, 315 bp, Artificial Sequence
  Synthetic oligonucleotide
atccagccttgggctcccaaaagtgttgggagtataggtgtaagccaccatgtccagctttttgtttgtttttttgagaaagttttttgattgaagatacaaaatttcttaaactcctgggacactgataaattcctcatttaaaaatgaggaaagataagcaaatttaaacataaaagataagtaaatcaccctttagaataagtactgctttggcaagatttggttttcttagaatagctttaggaattttgcttaaccctattgcttttagcagtttgtttttcatttcaatatctgttttattctctgcag

SEQ ID NO: 2511 - DNA, 181 bp, Artificial Sequence
  Synthetic oligonucleotide
ttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacg

SEQ ID NO: 2512 - DNA, 189 bp, Artificial Sequence
  Synthetic oligonucleotide
tacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaag

SEQ ID NO: 2513 - DNA, 175 bp, Artificial Sequence
  Synthetic oligonucleotide
cctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaag

SEQ ID NO: 2514 - DNA, 1203 bp, Artificial Sequence
  Synthetic oligonucleotide
tgagcccagactgtgccactacactccaacctgagcgacagagtgagaccctatctcaaaaaacaaaatgaaacaaaaagtttctcttattctggtgattttttttttattagttgtcttgcttcccttttccatatttgtattttccagatttggggttattaccttagcaggttttatataatttaaattactggattcaacattataaatgtgaagatggctaagtcatgatggccatattttgtcaaaatgctatttatatgtgaaaatgttggttttacttgacgcttattattgggtattataatttttatgtcaaagttcaggtaataaattgtgtcttactttgatttgcatttttaaattaatgagattgaaatatttggatgtcgtatgttaatttgtttcctaccttttaataatttatccattttgattatttgtatgaatttcttgggtaataatgtatcttttccatatttatcgcatgtatttttttcccattctttgctgttgtttctgttttttggagcaagggacatcgatatttcttaacttttaagtggtgggaacatcaaagaaaggtgggctgagaatacacgagtgctatgtcatgcaaattcttatgtcatatttaggggatttagacttcatcttgaaaaagctgaggaactactaaagattttttacttttaagcaccaagtgatacgatcagtttagaaagattactccaaaagcaatagagaggaaggagtagagagagttgaggctggagggcaggagatcaactaacaggctcttgtggttggtaatcttcaagaataatctgaaaaatgatggcagcctaaacaatggaagtttgaatggagaggagggatgggggtaagagagatttggtagaatagaattgagcacttgccgggaggagtcagcaggaggggagaaggaaaagtcttggctgtgttccaagtttgtagtctgtgtagcagggtggatggtggtgcccttcactaaagtaaagacgacagtggagaacatgtttgggttacataagcctccttgatgttggtgggttcaggtgggacatttgaaatgcctatgaagtcaggagggaattgaatatcctgatttgtttttattcactagttaaagcttgaaaaattttccttttttgacattaaatcttgttgttgttttag

SEQ ID NO: 2515 - DNA, 592 bp, Artificial Sequence
  Synthetic oligonucleotide
ggttcatctgtgcctcaaacctcggcatcatgtaatatacctttataacaaacctgcacatttagactcccctgagtctacaataaaagttgagggaaaaaaagatgactactggaaaattcataatagtattgggagtaacaattctaagaggaaaaaaataagctctgaatttatagtactcctttctgttatgaagtagataacatctatattaagccaaaatcagattcttgggaatagtcagtaggtttttatggttcttcaaatgacatcacatttcctaccattagaatcagatttcaaaataggaactttttcaggaaaatgaaggacagaatgtgggaacagactgtaaagaagaggcggggggagaagtactagctcaagagtaaaacggaatgggaaagcatagtcatttccttgagaatgatttagaagactgcttaggaagtactgttactatcatctggagatctgccagcatttcttttccattggaccatttagaaaccacaggtagagcaatcagtaccttaaagcacgtttttctcttctgtgtttgatttttgtttgtttgtttgactcacag

SEQ ID NO: 2516 - DNA, 90 bp, Artificial Sequence
  Synthetic oligonucleotide
attgttagccctgaaaacaccaaatctagctcagatgatgaggagcagctgacggagcttgatgaagaaatggagaatgaaatttgcaga

SEQ ID NO: 2517 - DNA, 24 bp, Artificial Sequence
  Synthetic oligonucleotide
gtatgggatatgtcaatggatgag

SEQ ID NO: 2518 - DNA, 84 bp, Artificial Sequence
  Synthetic oligonucleotide
gacgtggctttatttctccaagaatttaatgctcctgatatattcatgggagtactggccaagtccaagtgtcctcgattaaga

SEQ ID NO: 2519 - DNA, 4 bp, Artificial Sequence
  Synthetic oligonucleotide
gcag

SEQ ID NO: 2520 - DNA, 56 bp, Artificial Sequence
  Synthetic oligonucleotide
gtgttattgcactgtttgtatgattcagacccacctactctgctggaaacaagcag

SEQ ID NO: 2521 - DNA, 26 bp, Artificial Sequence
  Synthetic oligonucleotide
aaattcaacccacgtttaccatgtag

SEQ ID NO: 2522 - DNA, 29 bp, Artificial Sequence
  Synthetic oligonucleotide
gttgttgcttacttgcctttcccaggcag

SEQ ID NO: 2523 - DNA, 87 bp, Artificial Sequence
  Synthetic oligonucleotide
aagtggccagtgtttgggttgaaaggatccaggaacatccagctatttatgatagcatttgcttcattatgtcaagttcaacaaatg

SEQ ID NO: 2524 - DNA, 83 bp, Artificial Sequence
  Synthetic oligonucleotide
ttctgaaaatccagaatggcttgatgtttacatgcacattttacaactgcttactacagtggatgatggaattcaagcaattg

SEQ ID NO: 2525 - DNA, 22 bp, Artificial Sequence
  Synthetic oligonucleotide
tagatcttcctctaattgacag

SEQ ID NO: 2526 - DNA, 93 bp, Artificial Sequence
  Synthetic oligonucleotide
gagacggtggctcagggagtaaaggaaggccagttgagcaaacagaagtgttcctctgcatttcaaaaccttcttcctttctatagccctgtg

SEQ ID NO: 2527 - DNA, 81 bp, Artificial Sequence
  Synthetic oligonucleotide
gtggaagattttattaaaatcctacgtgaagttgataaggcgcttgctgatgacttggaaaaaaacttcccaagtttgaag

SEQ ID NO: 2528 - DNA, 100 bp, Artificial Sequence
  Synthetic oligonucleotide
gttcagacttaaaacctgaattggaattacttctgtacaagaaataaactttatttttctcactgacaaaaaaaaatgacttattggaaatattaactaa

SEQ ID NO: 2529 - DNA, 2701 bp, Homo sapiens
ctgagtcatctcatgtactcattcagacttcaaagtatcttagctttccattctttcaactaagccaagatgggaggtttctgttcattgtggaaagaggctcttttctcctcgtagccttactccaatgtttatctttaattattaacaagaattattaaatgcttatttcattgcttgcacagagtattcaaaaaactgaattttcctttccttagttctgcttgacacatttcatttcctcattgctcacctcttagccatttttctgccatacaggccctcctcctcatgccctcttttttttttttagcatttcgatacgtttctttccaattatttctatactttggaaaaatataattgaaaaaaatactgcatgtttttttttcacttgctattttaacataattattttcctgttaaaattattaactataattttgataactgctagatattttatcttacagctgtactaagcttcatctggccattttcctataattaagcatctaggtgctcatgtgtttacacatatatctttgttcacattgtttattatttccctacctaaggtttctagaagtgggattacaatggtaagcattttaagaggaatacaaaagctagtttcacattaagaactagaagtgacactgctgttttctcaccagcagaatactaacttttcaagtcccattcatattacgacaaaaaagaatggcttcacaaatctcattcattttataagtagcatcatcttcatcttaaaaatataagtcatctaattgtttacagtgttacacactgttcaaagaaccacatagctctgattccttccttccaaaaatttacattccaaggaagatatactgatgtgaagactcaccaaatgcagacaagaactattaaaagtaccccatggatggacctccaaatgagtttagggtaattgcgcttaaaatattaggaccaaagtacatttattttatagatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctcagtgagtcagcctggagttgtgtttgaaaaccacaggccctgactgtggctgtcagacctcccagacaccacctgctgctgcctatcatcatcttcaggtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccagaacaggcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaagtta

SEQ ID NO: 2530 - DNA, 2337 bp, Homo sapiens
cccaaagcggctccccaccctggccccagcctgggaactgggagctgtgggcaggagaggaaggaaagcagctctctcagctagcgagggggtcagggactgggccaagctcagaagcggggagaagagcgagacagagatgctctgagcaggggagacagggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctcagtgagtcagcctggagttgtgtttgaaaaccacaggccctgactgtggctgtcagacctcccagacaccacctgctgctgcctatcatcatcttcaggtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccagaacaggcctgagggagagggaaaagcggatacccacctgtgtcgctgtttgcgtgccaagtccaggaacagtccatacagccctgctgcatcccacgacgctgtcacaaagcaggagttcatccgaggccaaggtgttgtcatgagaatattcgttaaagtagggacgctgactttgttcttgggcagattctcttcctgtggagtatccagcctgtttgcctagttttcctgttcttctggggtctgatctctatctgttttactgcagtccagttaccaaagtggtataagtaaaattgaaagaattctaaataccttttccccccacgttagctgcctcacgttaatgtggtcttacggtctgcaaataagtgttttgatgatctggcgactgcagttacccatactagctctcctaccactcactactgacagttaattattatcgaatatccacccacccagggtgagttataagttataccaggtgttttggttaataatactaatgcaattaatttactgtttactctctcatcttaaagtaatcagctggtaaaataagatggattgggttggccaggtgcggtggctcacgcctgtaatcccagcactttgggaggctgaggtgggcggatcacgatatcaggagatcgagaccatcctggctaacacagtgaaaccctgtctctactaaaaatccaaaaaaaaa

SEQ ID NO: 2531 - DNA, 1888 bp, Homo sapiens
tgtgtgttgatttttttggtttttattgctagttatttctattacttacaagttaaaaatttatgtaattatatttgaccattttatttcatttctaatttctccatttgctccaattgtaagaaaattatcactttaaagtgagactaaaagccctatatattcttttaggtctctatttcccaccatccctgagattttactctgacattctctgggccttacagcccaggccctataattattcaacacattattttcacaaaggttagatgcttgcattatgacttcaattgagcagttaccttagagtctactacctacctatttatcctgtatttacaactatttcccatgttttctgttgtccaaggggcttacaacattcaaacccaacttcactcattcacttactcatttacttattcactcactcacactttcatttattcattcatttactatatttggcacacaaactctagggtgaccaccagggatccttgcttcctggtgtgttcactcgtgtgtaggcaggacctgggacttgcttctaaccaacagaatacggcaaaagtggtgggatgttcttcctgttattgtgttacataatataagacgctgtcttgctagtagactcactccagacactctccttgttggcttgatgaagtaagcagtcatgttgaggaagctctcatggtgaggaaccttgggcaaactctagccagcagtcagaaagaagcctggatacttggttttagagcagcatggaaatgaattctgccaataacctgagtgagcttaaaaggggtttcttcctcagtcaaatctccagatgagaacactgtccaggtgtcaccttgattacagtgttgtgagactctaagcagagggcccatctaagccatgcccttacctagaaactgtaagataataagtagttgttgtttagagccacaaagtatgcagtaatttgttatgcagaaatagaaaacaaatacacggtgctgtgctaatgatcacatgcatgatctcttagtgcttcaagtaacgtcataagcccgatactaatattatcttcatttacagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaagtta

SEQ ID NO: 2532 - DNA, 1562 bp, Homo sapiens
cccaaagcggctccccaccctggccccagcctgggaactgggagctgtgggcaggagaggaaggaaagcagctctctcagctagcgagggggtcagggactgggccaagctcagaagcggggagaagagcgagacagagatgctctgagcaggggagacagggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtaacaggcctgagggagagggaaaagcggatacccacctgtgtcgctgtttgcgtgccaagtccaggaacagtccatacagccctgctgcatcccacgacgctgtcacaaagcaggagttcatccgaggccaaggtgttgtcatgagaatattcgttaaagtagggacgctgactttgttcttgggcagattctcttcctgtggagtatccagcctgtttgcctagttttcctgttcttctggggtctgatctctatctgttttactgcagtccagttaccaaagtggtataagtaaaattgaaagaattctaaataccttttccccccacgttagctgcctcacgttaatgtggtcttacggtctgcaaataagtgttttgatgatctggcgactgcagttacccatactagctctcctaccactcactactgacagttaattattatcgaatatccacccacccagggtgagttataagttataccaggtgttttggttaataatactaatgcaattaatttactgtttactctctcatcttaaagtaatcagctggtaaaataagatggattgggttggccaggtgcggtggctcacgcctgtaatcccagcactttgggaggctgaggtgggcggatcacgatatcaggagatcgagaccatcctggctaacacagtgaaaccctgtctctactaaaaatccaaaaaaaaa

SEQ ID NO: 2533 - DNA, 192 bp, Artificial Sequence
  Synthetic oligonucleotide
cccaaagcggctccccaccctggccccagcctgggaactgggagctgtgggcaggagaggaaggaaagcagctctctcagctagcgagggggtcagggactgggccaagctcagaagcggggagaagagcgagacagagatgctctgagcaggggagacagggatcccgggctgctgccgctaccaacaagg

SEQ ID NO: 2534 - DNA, 321 bp, Artificial Sequence
  Synthetic oligonucleotide
gtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccag

SEQ ID NO: 2535 - DNA, 180 bp, Artificial Sequence
  Synthetic oligonucleotide
ggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccag

SEQ ID NO: 2536 - DNA, 997 bp, Artificial Sequence
  Synthetic oligonucleotide
ctgagtcatctcatgtactcattcagacttcaaagtatcttagctttccattctttcaactaagccaagatgggaggtttctgttcattgtggaaagaggctcttttctcctcgtagccttactccaatgtttatctttaattattaacaagaattattaaatgcttatttcattgcttgcacagagtattcaaaaaactgaattttcctttccttagttctgcttgacacatttcatttcctcattgctcacctcttagccatttttctgccatacaggccctcctcctcatgccctcttttttttttttagcatttcgatacgtttctttccaattatttctatactttggaaaaatataattgaaaaaaatactgcatgtttttttttcacttgctattttaacataattattttcctgttaaaattattaactataattttgataactgctagatattttatcttacagctgtactaagcttcatctggccattttcctataattaagcatctaggtgctcatgtgtttacacatatatctttgttcacattgtttattatttccctacctaaggtttctagaagtgggattacaatggtaagcattttaagaggaatacaaaagctagtttcacattaagaactagaagtgacactgctgttttctcaccagcagaatactaacttttcaagtcccattcatattacgacaaaaaagaatggcttcacaaatctcattcattttataagtagcatcatcttcatcttaaaaatataagtcatctaattgtttacagtgttacacactgttcaaagaaccacatagctctgattccttccttccaaaaatttacattccaaggaagatatactgatgtgaagactcaccaaatgcagacaagaactattaaaagtaccccatggatggacctccaaatgagtttagggtaattgcgcttaaaatattaggaccaaagtacatttattttatag

SEQ ID NO: 2537 - DNA, 163 bp, Artificial Sequence
  Synthetic oligonucleotide
atggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaag

SEQ ID NO: 2538 - DNA, 177 bp, Artificial Sequence
  Synthetic oligonucleotide
gtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctca

SEQ ID NO: 2539 - DNA, 338 bp, Artificial Sequence
  Synthetic oligonucleotide
gtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccag

SEQ ID NO: 2540 - DNA, 128 bp, Artificial Sequence
  Synthetic oligonucleotide
gcctgagggagagggaaaagcggatacccacctgtgtcgctgtttgcgtgccaagtccaggaacagtccatacagccctgctgcatcccacgacgctgtcacaaagcaggagttcatccgaggccaag

SEQ ID NO: 2541 - DNA, 555 bp, Artificial Sequence
  Synthetic oligonucleotide
gtagggacgctgactttgttcttgggcagattctcttcctgtggagtatccagcctgtttgcctagttttcctgttcttctggggtctgatctctatctgttttactgcagtccagttaccaaagtggtataagtaaaattgaaagaattctaaataccttttccccccacgttagctgcctcacgttaatgtggtcttacggtctgcaaataagtgttttgatgatctggcgactgcagttacccatactagctctcctaccactcactactgacagttaattattatcgaatatccacccacccagggtgagttataagttataccaggtgttttggttaataatactaatgcaattaatttactgtttactctctcatcttaaagtaatcagctggtaaaataagatggattgggttggccaggtgcggtggctcacgcctgtaatcccagcactttgggaggctgaggtgggcggatcacgatatcaggagatcgagaccatcctggctaacacagtgaaaccctgtctctactaaaaatccaaaaaaaaa

SEQ ID NO: 2542 - DNA, 1092 bp, Artificial Sequence
  Synthetic oligonucleotide
tgtgtgttgatttttttggtttttattgctagttatttctattacttacaagttaaaaatttatgtaattatatttgaccattttatttcatttctaatttctccatttgctccaattgtaagaaaattatcactttaaagtgagactaaaagccctatatattcttttaggtctctatttcccaccatccctgagattttactctgacattctctgggccttacagcccaggccctataattattcaacacattattttcacaaaggttagatgcttgcattatgacttcaattgagcagttaccttagagtctactacctacctatttatcctgtatttacaactatttcccatgttttctgttgtccaaggggcttacaacattcaaacccaacttcactcattcacttactcatttacttattcactcactcacactttcatttattcattcatttactatatttggcacacaaactctagggtgaccaccagggatccttgcttcctggtgtgttcactcgtgtgtaggcaggacctgggacttgcttctaaccaacagaatacggcaaaagtggtgggatgttcttcctgttattgtgttacataatataagacgctgtcttgctagtagactcactccagacactctccttgttggcttgatgaagtaagcagtcatgttgaggaagctctcatggtgaggaaccttgggcaaactctagccagcagtcagaaagaagcctggatacttggttttagagcagcatggaaatgaattctgccaataacctgagtgagcttaaaaggggtttcttcctcagtcaaatctccagatgagaacactgtccaggtgtcaccttgattacagtgttgtgagactctaagcagagggcccatctaagccatgcccttacctagaaactgtaagataataagtagttgttgtttagagccacaaagtatgcagtaatttgttatgcagaaatagaaaacaaatacacggtgctgtgctaatgatcacatgcatgatctcttagtgcttcaagtaacgtcataagcccgatactaatattatcttcatttacag

SEQ ID NO: 2543 - DNA, 204 bp, Artificial Sequence
  Synthetic oligonucleotide
atggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccag

SEQ ID NO: 2544 - DNA, 686 bp, Artificial Sequence
  Synthetic oligonucleotide
atgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaagttaaatgatggtggtttaattataagaagagtatactgaacactgataatctgatttgtatgcaattacttcggggaaggctgtacagaataatcta

SEQ ID NO: 2545 - DNA, 64 bp, Artificial Sequence
  Synthetic oligonucleotide
ggctagggagctctagtgacagtgtcttggtctggaatccaactctccaattttgaggccgcag

SEQ ID NO: 2546 - DNA, 91 bp, Artificial Sequence
  Synthetic oligonucleotide
gttctttttcttcaggatcaggcacagagactgactgaatggctccaattatcaggatttgaaaacccagtatcagaatctaccactttgt

SEQ ID NO: 2547 - DNA, 97 bp, Artificial Sequence
  Synthetic oligonucleotide
gtgagtcagcctggagttgtgtttgaaaaccacaggccctgactgtggctgtcagacctcccagacaccacctgctgctgcctatcatcatcttcag

SEQ ID NO: 2548 - DNA, 5 bp, Artificial Sequence
  Synthetic oligonucleotide
aacag

SEQ ID NO: 2549 - DNA, 26 bp, Artificial Sequence
  Synthetic oligonucleotide
gtgttgtcatgagaatattcgttaaa

SEQ ID NO: 2550 - DNA, 2973 bp, Homo sapiens
tagctacttgggagtctgaggtgggaggatcacttgagcccaggagatggaggctgcagggagccatgattgtgtcactgtactccagcctgggtgacagagtgagactctgtctcaaaacaaagacaaacccacacacacacaaaaacccccaaaacccagaaggaaaaagtagtacaagaaatctcaggatcgataacttttttccccttgattttgaaagattttcgtaactacaggtaggtcagagaatatattctttgaagataaaaagcacaacgtgcattactcaaatctcaacgtcagagctactgttgaatttaggtttatgtgaaaatgtgcatctaaagtctacttgaaaccctggtaatatacttttttttttaaagactgttaatatggacatgtttttagtaaggtctttaaagataactttaaagataaattaagagttgacacatcagtttctgaatgtggaagtcatttatcatgtaactttactgaaattaaagagagaatgcttctgagtgtcacaaggataactaaaagccacacaaggaggactgctggcccatttctctagttcacaggttgtgctcagctttagaagcccacacacgggcatccaaactgagtctctggaatagaaaaattaatgatggacttcctcccctatgtaaccttggaaggttttaagttacaccttggggaattggcaaatcattttcaacatgtattataaattatatgatgttaaaattatttttaattttttaaagtaaaagaaatgttacagtaggcttgccatagcttgaatgattgtgaaaacatcacataaacttccagaattttggttactaagaaaactggagtgtgtatgtgtgattttttagaattgttactgggttttgttttctgaaaatgttgactgtaatgacattttcaattagaaaagtgttttagttagtactgttatattttttgactcacagttaagtatcctatttgccaatgtttgtacctctgatggcaaaattatttgatatattagattagtatttgaagcaaataactttctcaacttgtgggaattttattatactaatagtgaaaatgttagaggataagattttaaatacttcttgatttaaattaaaatactataagaaatgtatgtatatttggatttgaagattttttttccccagatttataatgaatttggaacttacaagaacaatgaggatgatggtgcaatcagagtcatttagatagatggtgagccttttctgtccatgctatgattaagtcctctgtttaaacccaaatgcaatctgagtgacacatgaataaaattaattagattaattttgaaataagagaatatgcaaaattaaccaaaaaacccccagaaaacactggtcatctccttctctaatgaataaggaaataagatcataaatagtcccatctcaacatgcatatgcaattgaaaaaactgccctcacaggcaatcctggcacaatcctaggctcataaaatttctctatcttttcttgtaaataagtctccagtcatcattctaaatgggaatcatttttaatgaaataattataactgttttctgaaatataatcataatcagtgtttctagttcaaggtacaattgaactaatccataattttacccttttctttttgataagagagtgtttcatgagggtatctttggtagagatcttttctcaagtattttataaaatattcgagtttgatgaagatggtagataaatacaccagctgtcagatgcctataattttcacaaaatgtgaagaattcattgtatcttaggatgaccataaaaaaattcatggtgtggaatctctaagcattaatagagacaacagcgctactgcagtaatacacagctactacaaatcagtggcagagcaagaataagtggtgtatcaggcaatgtgaagtttttgccttttctcctaatgctgtggttgagttttcctggaaatgaaggaaaaaaacatagcaaaagtagggtgtgttaatgaatctgatgagcaacaagtctaaaaatagcaaaagtgcaaaatggaagttaaaaaacgcaactggcacctgaagcatatttccccttctttatctccagtgctatgcctctgctaaaaatatgaatcacaaagcaaaggaaaaagagaaaaaaagtgttgtaatacagtaaaaatcactataataaaagtttataagaattgagttttttggaattgactttggcctagtaaccattagtatttcttaatttttcagcatttattccatactaatgtgataacaactgtgtgtgttacctagagaaaatgctgtagatccacacatttgaacagaaatgtttatcgatgccataacgtgatacatttgctttccggtgttgttttttgtttatattatttagggaaattttaccttaccatcacagattttgttactttaataatgcagaactatatttatttaatctagattttgttttaaaattatcaagtgttagcttttacaaataagaggcttataatgtggccagatattcttagaattcttttaggtctaagtgttttcaaaactttaagaaatacattctatttttgcaccatttaaaattttgtttccttttaagttttattaagtacacgagaagtttattatttttcattgaatccaagtgaatttatggatatgtacttatcttttatatgaatgtaatagcttgctttcagttcctcacaggtcattgaaattatttaaccaatgaaaacattctctgttacttccaaagtcaactatgtttatcaaaatctcactagtgtgagaaaaataacaagtgtaatattaaagcattgtgcaatatcttgagttggaacataatattcagaaaattaaaatcatttaaaatgagtatg

SEQ ID NO: 2551 - DNA, 720 bp, Artificial Sequence
  Synthetic oligonucleotide
tagctacttgggagtctgaggtgggaggatcacttgagcccaggagatggaggctgcagggagccatgattgtgtcactgtactccagcctgggtgacagagtgagactctgtctcaaaacaaagacaaacccacacacacacaaaaacccccaaaacccagaaggaaaaagtagtacaagaaatctcaggatcgataacttttttccccttgattttgaaagattttcgtaactacaggtaggtcagagaatatattctttgaagataaaaagcacaacgtgcattactcaaatctcaacgtcagagctactgttgaatttaggtttatgtgaaaatgtgcatctaaagtctacttgaaaccctggtaatatacttttttttttaaagactgttaatatggacatgtttttagtaaggtctttaaagataactttaaagataaattaagagttgacacatcagtttctgaatgtggaagtcatttatcatgtaactttactgaaattaaagagagaatgcttctgagtgtcacaaggataactaaaagccacacaaggaggactgctggcccatttctctagttcacaggttgtgctcagctttagaagcccacacacgggcatccaaactgagtctctggaatagaaaaattaatgatggacttcctcccctatgtaaccttggaaggttttaagttacaccttggggaattggcaaa

SEQ ID NO: 2552 - DNA, 2253 bp, Artificial Sequence
  Synthetic oligonucleotide
tcattttcaacatgtattataaattatatgatgttaaaattatttttaattttttaaagtaaaagaaatgttacagtaggcttgccatagcttgaatgattgtgaaaacatcacataaacttccagaattttggttactaagaaaactggagtgtgtatgtgtgattttttagaattgttactgggttttgttttctgaaaatgttgactgtaatgacattttcaattagaaaagtgttttagttagtactgttatattttttgactcacagttaagtatcctatttgccaatgtttgtacctctgatggcaaaattatttgatatattagattagtatttgaagcaaataactttctcaacttgtgggaattttattatactaatagtgaaaatgttagaggataagattttaaatacttcttgatttaaattaaaatactataagaaatgtatgtatatttggatttgaagattttttttccccagatttataatgaatttggaacttacaagaacaatgaggatgatggtgcaatcagagtcatttagatagatggtgagccttttctgtccatgctatgattaagtcctctgtttaaacccaaatgcaatctgagtgacacatgaataaaattaattagattaattttgaaataagagaatatgcaaaattaaccaaaaaacccccagaaaacactggtcatctccttctctaatgaataaggaaataagatcataaatagtcccatctcaacatgcatatgcaattgaaaaaactgccctcacaggcaatcctggcacaatcctaggctcataaaatttctctatcttttcttgtaaataagtctccagtcatcattctaaatgggaatcatttttaatgaaataattataactgttttctgaaatataatcataatcagtgtttctagttcaaggtacaattgaactaatccataattttacccttttctttttgataagagagtgtttcatgagggtatctttggtagagatcttttctcaagtattttataaaatattcgagtttgatgaagatggtagataaatacaccagctgtcagatgcctataattttcacaaaatgtgaagaattcattgtatcttaggatgaccataaaaaaattcatggtgtggaatctctaagcattaatagagacaacagcgctactgcagtaatacacagctactacaaatcagtggcagagcaagaataagtggtgtatcaggcaatgtgaagtttttgccttttctcctaatgctgtggttgagttttcctggaaatgaaggaaaaaaacatagcaaaagtagggtgtgttaatgaatctgatgagcaacaagtctaaaaatagcaaaagtgcaaaatggaagttaaaaaacgcaactggcacctgaagcatatttccccttctttatctccagtgctatgcctctgctaaaaatatgaatcacaaagcaaaggaaaaagagaaaaaaagtgttgtaatacagtaaaaatcactataataaaagtttataagaattgagttttttggaattgactttggcctagtaaccattagtatttcttaatttttcagcatttattccatactaatgtgataacaactgtgtgtgttacctagagaaaatgctgtagatccacacatttgaacagaaatgtttatcgatgccataacgtgatacatttgctttccggtgttgttttttgtttatattatttagggaaattttaccttaccatcacagattttgttactttaataatgcagaactatatttatttaatctagattttgttttaaaattatcaagtgttagcttttacaaataagaggcttataatgtggccagatattcttagaattcttttaggtctaagtgttttcaaaactttaagaaatacattctatttttgcaccatttaaaattttgtttccttttaagttttattaagtacacgagaagtttattatttttcattgaatccaagtgaatttatggatatgtacttatcttttatatgaatgtaatagcttgctttcagttcctcacaggtcattgaaattatttaaccaatgaaaacattctctgttacttccaaagtcaactatgtttatcaaaatctcactagtgtgagaaaaataacaagtgtaatattaaagcattgtgcaatatcttgagttggaacataatattcagaaaattaaaatcatttaaaatgagtatg

SEQ ID NO: 2553 - DNA, 5802 bp, Homo sapiens
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcggtgagccgggatcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaatgccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgaggtgggaggatcacttgagcccaagagtttgaagctatggtgagctatgattgttccactatactccagcattggcaacagagcaagaactcatctctaaaaagtaaaaagcaactccccagaaagactgtatttctacagataaatattgcattgagatgccaaatagagtgttgttgtaaagtcatcagactagaaagcagacctggggacagtgtttaccacctaagaggcagtcctgtttttgagacccacatctatatatagagatttttgtttgtttgtttgtttgttttgttttgttttgagatgaagtctcactctgtcacccaggctggagtgcggtggcgcaatcttggctcactgcaacctccacctcccaggttcaagcaattctcctgcctcggcctcctgagtagctgggattacaggtgcgcactgccacgcctgactaatttttgtatttctagtagagatggggtttcactatgttggccaggctggtcttgaactcctcacctcaggtgatccacccatctcagcctcccaaagtgctgagattacaggcgtgagccaccacgcccggccagagatccacatctatatttataacacatttatggatgaaaattaaacaggtgtccgggtgcggttactcatgcctgtaatccgagcacttgtggaggccgaggcaggcggattacttgaggtcaggacttcgaaaccagcctggccaacatggtgaaatcccatctctactgaaaatacaaaattagccaggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaagggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgtgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctaaagcacgagaattatgtgcatcctggaggtgaaggttgcagtgagccaagatcacaccactccactccagtctggacaacagagtgagaccctgtgtcaaaaaaaaaaaaaagaaagaaagaaagaaaaaatgctttatggcccagtgcagtggctcacacctataatcctagcactttgggaggctaaggcaggaggattgcttgaggccaagagttcaaaacaagcctgggcaacattgcaagaccccaactctacaaaaaacgaaaaattagccgggagcggtgatgtgtgcctgtagtcccagctactcaggagactgaggtgggagaatcacttgagcctgggaggttgaggctgcagtgagctgtgtttataccactgcactccagcctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagttttggtttttctctttctaaccttctttttaaactagaaatataatacctatagaaaagtaaatgttggccgggtgcggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagaggttgcagtgagccgagatcgccccattgcactccagcttgagcaacaagagcgaaactgtctcaaaaaaaaaaaaaaagtatatgttaagtatagaaaaatatataaattaaaaaattataggcttgggggccaggcacagtggctcacacctgtaatcccagcactttgggaggccgaggtgggtgtatcacttgaggtcaggagtttgagaccagcctggccaacatggtgaaaccccgtctctaccaaaaaaaatatataaaaattatctgggtgtggtggcatgtgcctatagtctcagcttctcagaagactgaggcgtgagaatcacttgaacgatggaagtggaggttgcagtgagctgagatcacactactgcactacagtctgggcaacagagtgagaccttgtctca

SEQ ID NO: 2554 - DNA, 294 bp, Artificial Sequence
  Synthetic oligonucleotide
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagacta

SEQ ID NO: 2555 - DNA, 151 bp, Artificial Sequence
  Synthetic oligonucleotide
agtcggtatttcttcaatagatatatctcaaagcagaagctggctaacatcatcctggaacttcaattttcctaacatcagagatgcaataaaactttggacaaatagagtatggtctatatacagctggtgccagaactgcataacccag

SEQ ID NO: 2556 - DNA, 123 bp, Artificial Sequence
  Synthetic oligonucleotide
agtttagaagtattgaaagacaccatctttccatctcgtatctgccaccgagaactttacagtgtaaaacaacagttttgcattttggaaagtaaattatgcaagctccaggaagcactgaag

SEQ ID NO: 2557 - DNA, 243 bp, Artificial Sequence
  Synthetic oligonucleotide
accatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcag

SEQ ID NO: 2558 - DNA, 758 bp, Artificial Sequence
  Synthetic oligonucleotide
ctggccaacatggtgaaactccttccccactaaaaatacagaaattagctgggcatagtggcgggtgcctgtaatcccagctatgcgggaggctgaggcaggagaattgcttgaacccaagaggcggaggttgcggtgagccgggatcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagc

SEQ ID NO: 2559 - DNA, 402 bp, Artificial Sequence
  Synthetic oligonucleotide
ctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaatgccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgag

SEQ ID NO: 2560 - DNA, 204 bp, Artificial Sequence
  Synthetic oligonucleotide
gtgggaggatcacttgagcccaagagtttgaagctatggtgagctatgattgttccactatactccagcattggcaacagagcaagaactcatctctaaaaagtaaaaagcaactccccagaaagactgtatttctacagataaatattgcattgagatgccaaatagagtgttgttgtaaagtcatcagactagaaagcagac

SEQ ID NO: 2561 - DNA, 132 bp, Artificial Sequence
  Synthetic oligonucleotide
ctggggacagtgtttaccacctaagaggcagtcctgtttttgagacccacatctatatatagagatttttgtttgtttgtttgtttgttttgttttgttttgagatgaagtctcactctgtcacccaggctg

SEQ ID NO: 2562 - DNA, 137 bp, Artificial Sequence
  Synthetic oligonucleotide
atccacatctatatttataacacatttatggatgaaaattaaacaggtgtccgggtgcggttactcatgcctgtaatccgagcacttgtggaggccgaggcaggcggattacttgaggtcaggacttcgaaaccagc

SEQ ID NO: 2563 - DNA, 122 bp, Artificial Sequence
  Synthetic oligonucleotide
gtgaaatcccatctctactgaaaatacaaaattagccaggtgtggtgtcacgcacctgtagtcccagttacttgaacctgggaggcagaggttgcagtgagccgagattgcaacactgccac

SEQ ID NO: 2564 - DNA, 610 bp, Artificial Sequence
  Synthetic oligonucleotide
ctcaaaaaaaaaaaaaaaaaaattaaatgggtagtgacgttaagagatatatatcagcttctagtaaaagtttttttttttaaacctgctagctacatttacattatgtaaaaataaagggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgtgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgc

SEQ ID NO: 2565 - DNA, 1193 bp, Artificial Sequence
  Synthetic oligonucleotide
ctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctaaagcacgagaattatgtgcatcctggaggtgaaggttgcagtgagccaagatcacaccactccactccagtctggacaacagagtgagaccctgtgtcaaaaaaaaaaaaaagaaagaaagaaagaaaaaatgctttatggcccagtgcagtggctcacacctataatcctagcactttgggaggctaaggcaggaggattgcttgaggccaagagttcaaaacaagcctgggcaacattgcaagaccccaactctacaaaaaacgaaaaattagccgggagcggtgatgtgtgcctgtagtcccagctactcaggagactgaggtgggagaatcacttgagcctgggaggttgaggctgcagtgagctgtgtttataccactgcactccagcctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagttttggtttttctctttctaaccttctttttaaactagaaatataatacctatagaaaagtaaatgttggccgggtgcggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagag

SEQ ID NO: 2566 - DNA, 417 bp, Artificial Sequence
  Synthetic oligonucleotide
gttgcagtgagccgagatcgccccattgcactccagcttgagcaacaagagcgaaactgtctcaaaaaaaaaaaaaaagtatatgttaagtatagaaaaatatataaattaaaaaattataggcttgggggccaggcacagtggctcacacctgtaatcccagcactttgggaggccgaggtgggtgtatcacttgaggtcaggagtttgagaccagcctggccaacatggtgaaaccccgtctctaccaaaaaaaatatataaaaattatctgggtgtggtggcatgtgcctatagtctcagcttctcagaagactgaggcgtgagaatcacttgaacgatggaagtggaggttgcagtgagctgagatcacactactgcactacagtctgggcaacagagtgagaccttgtctca

SEQ ID NO: 2567 - DNA, 95 bp, Artificial Sequence
  Synthetic oligonucleotide
aaatcatgcccaagttcaaacaacgaagacgaaagctaaaagccaaagccgaaagattattcaaaaaaaaagaagcctctcactttcagtccaag

SEQ ID NO: 2568 - DNA, 38 bp, Artificial Sequence
  Synthetic oligonucleotide
ctaattacacctcctcctccaccaccctcaccagaaag

SEQ ID NO: 2569 - DNA, 99 bp, Artificial Sequence
  Synthetic oligonucleotide
gctggaccattaaaaaaagatggacccatgcagataacagttaaagatctgctgactgtaaaattaaagaagacacagagtttagatgaaaagaggaag

SEQ ID NO: 2570 - DNA, 113 bp, Artificial Sequence
  Synthetic oligonucleotide
cttataccatcgccgaaagcacggaatccactagttaccgtctctgacttgcagcatgttaccctgaaacctaactccaaagtgttatcgactcgagttacaaacgtcttaat

SEQ ID NO: 2571 - DNA, 60 bp, Artificial Sequence
  Synthetic oligonucleotide
cactcctggaaaaagtcagatggatctgcggaaactgcttagaaaagtcgatgtagagag

SEQ ID NO: 2572 - DNA, 97 bp, Artificial Sequence
  Synthetic oligonucleotide
gagcccaggtggaacccctcttaccaataaggaaaatatggaaacaggaacaggactgactccagtgatgacgcaggccttaaggagaaagtttcag

SEQ ID NO: 2573 - DNA, 19 bp, Artificial Sequence
  Synthetic oligonucleotide
ctggctcaccctagaagcc

SEQ ID NO: 2574 - DNA, 18 bp, Artificial Sequence
  Synthetic oligonucleotide
caactccaactctgccac

SEQ ID NO: 2575 - DNA, 57 bp, Artificial Sequence
  Synthetic oligonucleotide
tttctacaagcagctttgatgaacaaaactgatgccaactctgcctcactccatgag

SEQ ID NO: 2576 - DNA, 54 bp, Artificial Sequence
  Synthetic oligonucleotide
atgatccataacaaatacagataaaaacacccagctgggtgcagtggctcacac

SEQ ID NO: 2577 - DNA, 33 bp, Artificial Sequence
  Synthetic oligonucleotide
ctgtaatcccagcactttgggaggctgaggcag

SEQ ID NO: 2578 - DNA, 34 bp, Artificial Sequence
  Synthetic oligonucleotide
gtggatcacctgaggtcaggagtttgagaccagc

SEQ ID NO: 2579 - DNA, 53 bp, Artificial Sequence
  Synthetic oligonucleotide
gagtgcggtggcgcaatcttggctcactgcaacctccacctcccaggttcaag

SEQ ID NO: 2580 - DNA, 109 bp, Artificial Sequence
  Synthetic oligonucleotide
caattctcctgcctcggcctcctgagtagctgggattacaggtgcgcactgccacgcctgactaatttttgtatttctagtagagatggggtttcactatgttggccag

SEQ ID NO: 2581 - DNA, 25 bp, Artificial Sequence
  Synthetic oligonucleotide
gctggtcttgaactcctcacctcag

SEQ ID NO: 2582 - DNA, 68 bp, Artificial Sequence
  Synthetic oligonucleotide
gtgatccacccatctcagcctcccaaagtgctgagattacaggcgtgagccaccacgcccggccagag

SEQ ID NO: 2583 - DNA, 12 bp, Artificial Sequence
  Synthetic oligonucleotide
ctggccaacatg

SEQ ID NO: 2584 - DNA, 5 bp, Artificial Sequence
  Synthetic oligonucleotide
tccag

SEQ ID NO: 2585 - DNA, 27 bp, Artificial Sequence
  Synthetic oligonucleotide
cctgggtgacagagcaagagaccctgt

SEQ ID NO: 2586 - DNA, 1790 bp, Homo sapiens
accagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaagagcaccccaagatctggctacctcgggccctgaggcagacctacatccggaaggttggggacacagtgaacctactaatcccattccagggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattgagaggccaggccctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcaccacggacctcgcccacatccagaaagcagctactgtttacaagaccaaggggtttgcccaacgagacttctctgaagccccaaagtttacccagcctctggccaactgcactacagtcaccggctataatacccagctcttctgctgtgtccgcgcctctccccggcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatcgtactctgacaaaggtgtgtggtcccaagcagcacattattggcaaaagacagctcagctcatcatttagaaccggacagctcttttagattttccgtcattcacattagctatgttgtgaacaaagtgatgcataaggcgaaaaagaagcttgagacagaactaaagagaacaagttcccagtgtcctctctgacttgtagctgctggctgatggaaattggaaatgaatttgatcccataagacatttatttcaggctctcactggtatgtagcaaatgaaagcctaaaggggtgcgttacaagtacagacttctcaggaaagcgctctccgacagtcggcttgcagagacaactctccctccctcacctccctctctgtgttaatgatacttgtgttcgtgttagttgcccctttccctctctcacagccagtgcccagcaatgaagtgaattcatggcacaggagccagggaccgtgacaacggtgccctcagcagcctggtgtcctctggccatttgctgtcatggctacaaagtgctccctcttttcagtgcctccaggaagcccgccagtggtgagactgtgtcctcaaggagcttcggcaccatgtctggtttggattcatctaaataaatatgtggttccccagtgc

SEQ ID NO: 2587 - DNA, 1107 bp, Homo sapiens
accagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaagagcaccccaagatctggctacctcgggccctgaggcagacctacatccggaaggttggggacacagtgaacctactaatcccattccagggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattgagaggccaggccctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcaccacggacctcgcccacatccagaaagcaggtaagggaggcatggggatcatgagctgggaagacttaaggataggccgggcacagtggctcacgcctctaattccagcactttgggaggccaaggcaggcggatcacctgaggtcaggagttcaagaccagcctggacaacatggtgaaacctcatctctactaaaaatacaaaaattagccaggcatggtggtgcacgcctgtactcccagctactcaggaggctaaggcaggagaattgcttgaacttgggagttggaggttgcagtgagctgagatcgtgccactgcactccagcctgggcaatagagtgagactccacctca

SEQ ID NO: 2588 - DNA, 879 bp, Homo sapiens
aggctctctgtctatttacaatctagtcatcatgctccacacacagcagaaaacaccattaacaacctgtaccaagaatcttttgggttttgagtctgggcaagactacatggagataacatctcagaaggggcatatcaagagcccactctagaagctactctctaaccagaggggacagaggcaactcacaagtcagcagtgggaacagaatatggatggttcacaagaggtgagcctgatgctcagtgcttctgatccataaaggggctgcctgagagcccggaacggaagttagcagttttcttccagtcagaaatattggtaaagaaaatgaagtttcaggtgctattttcaaacaagagaaggagcttgggggactgctggtggcactggaaggggaaacccttcccacaacataaggaacagggagccttccagaaagccattatctctatatagacagagtcccagaaactgagcacagaaagactattggttcttaccctcgcccctccttgctgcctccctcatctttgtcttccagcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatcgtactctgacaaagtgcctccaggaagcccgccagtggtgagactgtgtcctcaaggagcttcggcaccatgtctggtttggattcatctaaataaatatgtggttccccagtgc

SEQ ID NO: 2589 - DNA, 1068 bp, Homo sapiens
accagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaagcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatcgtactctgacaaaggtgtgtggtcccaagcagcacattattggcaaaagacagctcagctcatcatttagaaccggacagctcttttagattttccgtcattcacattagctatgttgtgaacaaagtgatgcataaggcgaaaaagaagcttgagacagaactaaagagaacaagttcccagtgtcctctctgacttgtagctgctggctgatggaaattggaaatgaatttgatcccataagacatttatttcaggctctcactggtatgtagcaaatgaaagcctaaaggggtgcgttacaagtacagacttctcaggaaagcgctctccgacagtcggcttgcagagacaactctccctccctcacctccctctctgtgttaatgatacttgtgttcgtgttagttgcccctttccctctctcacagccagtgcccagcaatgaagtgaattcatggcacaggagccagggaccgtgacaacggtgccctcagcagcctggtgtcctctggccatttgctgtcatggctacaaagtgctccctcttttcagtgcctccaggaagcccgccagtggtgagactgtgtcctcaaggagcttcggcaccatgtctggtttggattcatctaaataaatatgtggttccccagtgc

SEQ ID NO: 2590 - DNA, 195 bp, Artificial Sequence
  Synthetic oligonucleotide
accagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaag

SEQ ID NO: 2591 - DNA, 196 bp, Artificial Sequence
  Synthetic oligonucleotide
ggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattg

SEQ ID NO: 2592 - DNA, 140 bp, Artificial Sequence
  Synthetic oligonucleotide
agaggccaggccctcctcagagtattaagctggtggacgtttggggcttcagcgctacactggaatggacaccgccccaagatacggggaatacagcacttctgggatacacggtgcagaaggctgacacaaaatccggg

SEQ ID NO: 2593 - DNA, 160 bp, Artificial Sequence
  Synthetic oligonucleotide
ctgtggttcacggtgctggagcactatcaccgcaccagctgcatcgtctctgacctcatcatcggcaactcctatgccttccgtgtctttgctgaaaaccagtgcggactcagtgaaacagcccccatcaccacggacctcgcccacatccagaaagcag

SEQ ID NO: 2594 - DNA, 327 bp, Artificial Sequence
  Synthetic oligonucleotide
gtaagggaggcatggggatcatgagctgggaagacttaaggataggccgggcacagtggctcacgcctctaattccagcactttgggaggccaaggcaggcggatcacctgaggtcaggagttcaagaccagcctggacaacatggtgaaacctcatctctactaaaaatacaaaaattagccaggcatggtggtgcacgcctgtactcccagctactcaggaggctaaggcaggagaattgcttgaacttgggagttggaggttgcagtgagctgagatcgtgccactgcactccagcctgggcaatagagtgagactccacctca

SEQ ID NO: 2595 - DNA, 137 bp, Artificial Sequence
  Synthetic oligonucleotide
ctactgtttacaagaccaaggggtttgcccaacgagacttctctgaagccccaaagtttacccagcctctggccaactgcactacagtcaccggctataatacccagctcttctgctgtgtccgcgcctctccccgg

SEQ ID NO: 2596 - DNA, 547 bp, Artificial Sequence
  Synthetic oligonucleotide
aggctctctgtctatttacaatctagtcatcatgctccacacacagcagaaaacaccattaacaacctgtaccaagaatcttttgggttttgagtctgggcaagactacatggagataacatctcagaaggggcatatcaagagcccactctagaagctactctctaaccagaggggacagaggcaactcacaagtcagcagtgggaacagaatatggatggttcacaagaggtgagcctgatgctcagtgcttctgatccataaaggggctgcctgagagcccggaacggaagttagcagttttcttccagtcagaaatattggtaaagaaaatgaagtttcaggtgctattttcaaacaagagaaggagcttgggggactgctggtggcactggaaggggaaacccttcccacaacataaggaacagggagccttccagaaagccattatctctatatagacagagtcccagaaactgagcacagaaagactattggttcttaccctcgcccctccttgctgcctccctcatctttgtcttccag

SEQ ID NO: 2597 - DNA, 187 bp, Artificial Sequence
  Synthetic oligonucleotide
cccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaag

SEQ ID NO: 2598 - DNA, 417 bp, Artificial Sequence
  Synthetic oligonucleotide
gtgtgtggtcccaagcagcacattattggcaaaagacagctcagctcatcatttagaaccggacagctcttttagattttccgtcattcacattagctatgttgtgaacaaagtgatgcataaggcgaaaaagaagcttgagacagaactaaagagaacaagttcccagtgtcctctctgacttgtagctgctggctgatggaaattggaaatgaatttgatcccataagacatttatttcaggctctcactggtatgtagcaaatgaaagcctaaaggggtgcgttacaagtacagacttctcaggaaagcgctctccgacagtcggcttgcagagacaactctccctccctcacctccctctctgtgttaatgatacttgtgttcgtgttagttgcccctttccctctctcacag

SEQ ID NO: 2599 - DNA, 124 bp, Artificial Sequence
  Synthetic oligonucleotide
ccagtgcccagcaatgaagtgaattcatggcacaggagccagggaccgtgacaacggtgccctcagcagcctggtgtcctctggccatttgctgtcatggctacaaagtgctccctcttttcag

SEQ ID NO: 2600 - DNA, 89 bp, Artificial Sequence
  Synthetic oligonucleotide
agcaccccaagatctggctacctcgggccctgaggcagacctacatccggaaggttggggacacagtgaacctactaatcccattccag

SEQ ID NO: 2601 - DNA, 44 bp, Artificial Sequence
  Synthetic oligonucleotide
ttcctaattgaggacacctaagaaggcatcgtactctgacaaag

SEQ ID NO: 2602 - DNA, 101 bp, Artificial Sequence
  Synthetic oligonucleotide
tgcctccaggaagcccgccagtggtgagactgtgtcctcaaggagcttcggcaccatgtctggtttggattcatctaaataaatatgtggttccccagtgc

SEQ ID NO: 2603 - DNA, 4414 bp, Homo sapiens
tctcaggttcacccctgccggccatggacttcctcctgcggcctcaggtgcgaggggtctgcgaccctctctccccatggcggcaagctccctgcgcctctccccgtcccctcgtcccacggggctgcttctggtgggagtggggctgggcgcttaggggagccaggagatggacaggagccttcctcacagaggggagaagccagccccctggcccgctcaccttctcttatccggtgttctgccagtcccagctgctccagtccccacctcgcccctaagacccgcccttcaccccagccctccccgcgctcttccttgttctggctgctggcaccgctatggagggggctgcatacccccgcccttggagatcccgatgcccttcaggtccagaagctcttgagcaaatatttggcggcgcctggagctgagaccgtgggtgggtggggggctggaccaaggctgcctggccaggcggctgccgcttagctgggctgagctcttacaagcgccgcattccctgccggctgtgccggccggccgctgctccgcgcccgcaggatgactcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2604 - DNA, 4226 bp, Homo sapiens
gatggagtgctggtcggaagcgggcattccggggtccccttctcagagttccctaaagccagggtgccgcgccccctgccaccaggagggggtagtctccccgaggcgccgccggccctcccactccccggctggctccagaccacccctcccctccggcccccccgcatagtccttcagtcccgtccggggcgcccagactgggggttgcccggggcccccatccccaatctccgggttgagaggcgaagccaggaaaggcgggtggcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2605 - DNA, 4296 bp, Homo sapiens
gagacggagtctcactctgtcacccaggctggagtgcagtggcacgatcttggctcactgcaacctccgcctcccaggttcaagtaattctcctgcctcagcctcctgagtagctgggattactggtgtccgccaccacgcctggctaatttttgtgtttttagtagagatggggtttcaccatgttggtcaggctggtcttgaactcctgacctccagcaatccacccacctcagcctcccaaagtgctgggattacaggtgtgagccactgtgcctggcctgggtccctatatttaagggacagctgctgggggcatatagagccaccagcattagaggagatagctgctggcgggggagggttcctgggtctctggcactgggaagggtgaggtttcggggtacaattcccagtgagccctgtgtgttttctctctgccttcttcctcacagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2606 - DNA, 4277 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtgtgagggggcaggcaggggagggggaggtggggggatcaggtttgactgtccagcaaagaagggactggggtcctagtgggaggagtggggctagggggcaggatggcaggggagggacactgtgcctgccacagccaagtccccctcctccctgcagaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2607 - DNA, 3915 bp, Homo sapiens
ggccacccagtgtggcagagagaagggagagagcagaagctggcgtctgtgaagcctgaggcttacccctcctcccagggcaggaagctgtctgccatctccaaggcccggtgccacggactttattcctcttgattaaacataggcccctgtgaacctctgagtcccatgtctagggatgtgccagggggtgagggggcagggggatgaatgctgactgtcaggaagcagcgtcctgagctccttttctgcaccaggacctgcactgggacttttccaaaatctcacccctcatggcaccgccaaaggctggtctcagccctggctgctgaggagcagttgacgttcgcagtggccgttcagaggggcctcggggtgaccgtttggggctgcacagccagaaaagggtggagctggggttcggatgctggcagtctgcatccagaatcctccccctccccgtgcccgcacctcccgggagtgggagctaggagggcctggagtccgatgtgggtcccctccctggctaccgcctgcgtgggtgctgggcgtgggggaggaggccaggtttctcgggctcacggccattctgtctgcctagaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2608 - DNA, 4279 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaaggtcagctaccctcctcctctgggccctgcttcctggagcccatcctaggccagtcttgatccccatgactgcctcccacccactggccttgcccaccctcagctccaggccctcagccctcttctttgtgctctcccccatccccatgctgctttggcagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2609 - DNA, 4268 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaaggtcagctaccctcctcctctgggccctgcttcctggagcccatcctaggccagtcttgatccccatgactgcctcccacccactggccttgcccaccctcagctccaggccctcagccctcttctttgtgctctcccccatccccatgctgctttggcagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2610 - DNA, 4532 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgtgagtggtcctagccaaaggggtgtgagaggccagagccccaggccaggctggggaactcagcatggaacctccagccacactgggcaatcccagggacctcagggaaccttggatgcccagatggccacagtttattctgtagacagcagaaaaaccccgatgtttgctgggacaggaacagcacgtggaggggcaggccaccctggcagtgctagctgggagctgtcatggacgataagggctgggggcccaggttttgctctgtaacggaatttgaatcctgacggaatggacagggaccgccaggttccaaagccagatggagggactggctgggcattctggaaagaccctgtggtctgcggagctgagtccagcctgggcctcagcagcacccctcccgctctcaggctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2611 - DNA, 4356 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagaggctcttcccagcagcaggctagggaggaagctgggctcacctgtctccgccccccaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2612 - DNA, 4637 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccgggtgcgtgggcttaaaggccaagagggggttaggggcaggaaggggggtggcaggaagtcagcggctgtggtggcaggactctgagcgctgtgcctgcccactcagatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgtgagtggtcctagccaaaggggtgtgagaggccagagccccaggccaggctggggaactcagcatggaacctccagccacactgggcaatcccagggacctcagggaaccttggatgcccagatggccacagtttattctgtagacagcagaaaaaccccgatgtttgctgggacaggaacagcacgtggaggggcaggccaccctggcagtgctagctgggagctgtcatggacgataagggctgggggcccaggttttgctctgtaacggaatttgaatcctgacggaatggacagggaccgccaggttccaaagccagatggagggactggctgggcattctggaaagaccctgtggtctgcggagctgagtccagcctgggcctcagcagcacccctcccgctctcaggctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2613 - DNA, 4456 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagaggctcttcccagcagcaggctagggaggaagctgggctcacctgtctccgccccccaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtgtaagccctcccgtctgcctcccccggttcctcttgcctccctgtggatctggaaaggcccccccacttcccttcttgaccgccacctccccacacacagctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacctaaaatgt

SEQ ID NO: 2614 - DNA, 2016 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggtaaccccgctcccctccacctcccgcctggccagtccccaggaaattctcccacatggccccaaatctgtcttgagccccacgttgtgtgacagccccagagcccagaggaagcatggtccacacccagctcacatttgcattttcggccagcagcttcttgatattctcagataacaactgaagccgatgtgttttggttgcgaaaatgttcgagaagctatttagatgtaaagctttctgaaattcctggcatgccttggtaccatcttagagattctgtggaatgtgatctaatctgcagctgtgtagacctcacgaaatgaccaccgaccacagatgcaggacttccaagccctgtgtttgcttgcttgctccttcccaatgagtgaccactctcagttgttgttaaaaggcctgtttctaagcagctgaggttctgtggtttgaggcagcctaggaaaaaaattaattttttttttcgagacaggatcttgctctgttgcccaggctggagtacagtggtgtgatcttggctcactgcaacctccacctcccatgctcaagtgatcctcctgcctcagcctcccaagtagctggaactacaggcgcgtgctaccatgcctgcctaattgttttatt

SEQ ID NO: 2615 - DNA, 2096 bp, Homo sapiens
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcaggtgcgctgggtgcgggctcctagggcatgtcggcagggccctggcctggtcactcctgcccatgtgggtccctgttacagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggtaaccccgctcccctccacctcccgcctggccagtccccaggaaattctcccacatggccccaaatctgtcttgagccccacgttgtgtgacagccccagagcccagaggaagcatggtccacacccagctcacatttgcattttcggccagcagcttcttgatattctcagataacaactgaagccgatgtgttttggttgcgaaaatgttcgagaagctatttagatgtaaagctttctgaaattcctggcatgccttggtaccatcttagagattctgtggaatgtgatctaatctgcagctgtgtagacctcacgaaatgaccaccgaccacagatgcaggacttccaagccctgtgtttgcttgcttgctccttcccaatgagtgaccactctcagttgttgttaaaaggcctgtttctaagcagctgaggttctgtggtttgaggcagcctaggaaaaaaattaattttttttttcgagacaggatcttgctctgttgcccaggctggagtacagtggtgtgatcttggctcactgcaacctccacctcccatgctcaagtgatcctcctgcctcagcctcccaagtagctggaactacaggcgcgtgctaccatgcctgcctaattgttttatt

SEQ ID NO: 2616 - DNA, 164 bp, Artificial Sequence
  Synthetic oligonucleotide
ggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgg

SEQ ID NO: 2617 - DNA, 271 bp, Artificial Sequence
  Synthetic oligonucleotide
gatggagtgctggtcggaagcgggcattccggggtccccttctcagagttccctaaagccagggtgccgcgccccctgccaccaggagggggtagtctccccgaggcgccgccggccctcccactccccggctggctccagaccacccctcccctccggcccccccgcatagtccttcagtcccgtccggggcgcccagactgggggttgcccggggcccccatccccaatctccgggttgagaggcgaagccaggaaaggcgggtggcgg

SEQ ID NO: 2618 - DNA, 526 bp, Artificial Sequence
  Synthetic oligonucleotide
gtgcgaggggtctgcgaccctctctccccatggcggcaagctccctgcgcctctccccgtcccctcgtcccacggggctgcttctggtgggagtggggctgggcgcttaggggagccaggagatggacaggagccttcctcacagaggggagaagccagccccctggcccgctcaccttctcttatccggtgttctgccagtcccagctgctccagtccccacctcgcccctaagacccgcccttcaccccagccctccccgcgctcttccttgttctggctgctggcaccgctatggagggggctgcatacccccgcccttggagatcccgatgcccttcaggtccagaagctcttgagcaaatatttggcggcgcctggagctgagaccgtgggtgggtggggggctggaccaaggctgcctggccaggcggctgccgcttagctgggctgagctcttacaagcgccgcattccctgccggctgtgccggccggccgctgctccgcgcccgcaggatgactcag

SEQ ID NO: 2619 - DNA, 350 bp, Artificial Sequence
  Synthetic oligonucleotide
ctgagtagctgggattactggtgtccgccaccacgcctggctaatttttgtgtttttagtagagatggggtttcaccatgttggtcaggctggtcttgaactcctgacctccagcaatccacccacctcagcctcccaaagtgctgggattacaggtgtgagccactgtgcctggcctgggtccctatatttaagggacagctgctgggggcatatagagccaccagcattagaggagatagctgctggcgggggagggttcctgggtctctggcactgggaagggtgaggtttcggggtacaattcccagtgagccctgtgtgttttctctctgccttcttcctcacag

SEQ ID NO: 2620 - DNA, 166 bp, Artificial Sequence
  Synthetic oligonucleotide
ccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagt

SEQ ID NO: 2621 - DNA, 158 bp, Artificial Sequence
  Synthetic oligonucleotide
gtgagggggcaggcaggggagggggaggtggggggatcaggtttgactgtccagcaaagaagggactggggtcctagtgggaggagtggggctagggggcaggatggcaggggagggacactgtgcctgccacagccaagtccccctcctccctgcag

SEQ ID NO: 2622 - DNA, 164 bp, Artificial Sequence
  Synthetic oligonucleotide
cccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcag

SEQ ID NO: 2623 - DNA, 601 bp, Artificial Sequence
  Synthetic oligonucleotide
ggccacccagtgtggcagagagaagggagagagcagaagctggcgtctgtgaagcctgaggcttacccctcctcccagggcaggaagctgtctgccatctccaaggcccggtgccacggactttattcctcttgattaaacataggcccctgtgaacctctgagtcccatgtctagggatgtgccagggggtgagggggcagggggatgaatgctgactgtcaggaagcagcgtcctgagctccttttctgcaccaggacctgcactgggacttttccaaaatctcacccctcatggcaccgccaaaggctggtctcagccctggctgctgaggagcagttgacgttcgcagtggccgttcagaggggcctcggggtgaccgtttggggctgcacagccagaaaagggtggagctggggttcggatgctggcagtctgcatccagaatcctccccctccccgtgcccgcacctcccgggagtgggagctaggagggcctggagtccgatgtgggtcccctccctggctaccgcctgcgtgggtgctgggcgtgggggaggaggccaggtttctcgggctcacggccattctgtctgcctag

SEQ ID NO: 2624 - DNA, 208 bp, Artificial Sequence
  Synthetic oligonucleotide
aacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcc

SEQ ID NO: 2625 - DNA, 143 bp, Artificial Sequence
  Synthetic oligonucleotide
gtcaccggtttgaggacgttcctggggtgcggcggcacttggtgcggaagaatgccaaaggttccacacagagtggccgagaagggcgggagcctggccccacacctcgggcccgaccccgggccccccacaagccccatgag

SEQ ID NO: 2626 - DNA, 181 bp, Artificial Sequence
  Synthetic oligonucleotide
gtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatg

SEQ ID NO: 2627 - DNA, 642 bp, Artificial Sequence
  Synthetic oligonucleotide
gtaaccccgctcccctccacctcccgcctggccagtccccaggaaattctcccacatggccccaaatctgtcttgagccccacgttgtgtgacagccccagagcccagaggaagcatggtccacacccagctcacatttgcattttcggccagcagcttcttgatattctcagataacaactgaagccgatgtgttttggttgcgaaaatgttcgagaagctatttagatgtaaagctttctgaaattcctggcatgccttggtaccatcttagagattctgtggaatgtgatctaatctgcagctgtgtagacctcacgaaatgaccaccgaccacagatgcaggacttccaagccctgtgtttgcttgcttgctccttcccaatgagtgaccactctcagttgttgttaaaaggcctgtttctaagcagctgaggttctgtggtttgaggcagcctaggaaaaaaattaattttttttttcgagacaggatcttgctctgttgcccaggctggagtacagtggtgtgatcttggctcactgcaacctccacctcccatgctcaagtgatcctcctgcctcagcctcccaagtagctggaactacaggcgcgtgctaccatgcctgcctaattgttttatt

SEQ ID NO: 2628 - DNA, 136 bp, Artificial Sequence
  Synthetic oligonucleotide
gggctgtgctcttggatctggaccagcagaccctgcccggagtggcccaccaggtggtggagcagatggtcatctctgaccagatcaaggccgaggacagggccaacgtgctgcgggctctgctgttgaaacacag

SEQ ID NO: 2629 - DNA, 166 bp, Artificial Sequence
  Synthetic oligonucleotide
ccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagag

SEQ ID NO: 2630 - DNA, 160 bp, Artificial Sequence
  Synthetic oligonucleotide
gtcagctaccctcctcctctgggccctgcttcctggagcccatcctaggccagtcttgatccccatgactgcctcccacccactggccttgcccaccctcagctccaggccctcagccctcttctttgtgctctcccccatccccatgctgctttggcag

SEQ ID NO: 2631 - DNA, 150 bp, Artificial Sequence
  Synthetic oligonucleotide
caattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatg

SEQ ID NO: 2632 - DNA, 149 bp, Artificial Sequence
  Synthetic oligonucleotide
gagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcg

SEQ ID NO: 2633 - DNA, 120 bp, Artificial Sequence
  Synthetic oligonucleotide
ctcatggtggccctggaggggagcttcctggtccgcttcgtctcccgcttcacccaggagatcttcgccttcttgatctcactcatcttcatctatgagaccttctacaagctggtgaag

SEQ ID NO: 2634 - DNA, 168 bp, Artificial Sequence
  Synthetic oligonucleotide
atcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggcc

SEQ ID NO: 2635 - DNA, 138 bp, Artificial Sequence
  Synthetic oligonucleotide
gtgagtggtcctagccaaaggggtgtgagaggccagagccccaggccaggctggggaactcagcatggaacctccagccacactgggcaatcccagggacctcagggaaccttggatgcccagatggccacagtttat

SEQ ID NO: 2636 - DNA, 275 bp, Artificial Sequence
  Synthetic oligonucleotide
tctgtagacagcagaaaaaccccgatgtttgctgggacaggaacagcacgtggaggggcaggccaccctggcagtgctagctgggagctgtcatggacgataagggctgggggcccaggttttgctctgtaacggaatttgaatcctgacggaatggacagggaccgccaggttccaaagccagatggagggactggctgggcattctggaaagaccctgtggtctgcggagctgagtccagcctgggcctcagcagcacccctcccgctctcag

SEQ ID NO: 2637 - DNA, 126 bp, Artificial Sequence
  Synthetic oligonucleotide
gctcatcatctccaagaaggagcgcatgctgcagaagggctccggcttccacctggacctgctgctcatcgtggccatgggcggcatctgtgccctctttggcctgccctggttggctgctgccac

SEQ ID NO: 2638 - DNA, 128 bp, Artificial Sequence
  Synthetic oligonucleotide
tgtccgctctgtcactcacgccaacgcgctcactgtcatgagcaaggctgtggcacctggggacaagcccaagattcaggaagtcaaggagcagcgggtgacggggctgctggttgccctgcttgtgg

SEQ ID NO: 2639 - DNA, 170 bp, Artificial Sequence
  Synthetic oligonucleotide
gcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaag

SEQ ID NO: 2640 - DNA, 237 bp, Artificial Sequence
  Synthetic oligonucleotide
gtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagaggctcttcccagcagcaggctagggaggaagctgggctcacctgtctccgccccccag

SEQ ID NO: 2641 - DNA, 150 bp, Artificial Sequence
  Synthetic oligonucleotide
ctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcc

SEQ ID NO: 2642 - DNA, 114 bp, Artificial Sequence
  Synthetic oligonucleotide
gttatgcctccgcctcgttgccctgaaagccgcagcgacagcgaaaagggctaagattcggccatgagcagcgcccctcggcgccccgccaagggcgcagattctttctgtacg

SEQ ID NO: 2643 - DNA, 47 bp, Artificial Sequence
  Synthetic oligonucleotide
tctcaggttcacccctgccggccatggacttcctcctgcggcctcag

SEQ ID NO: 2644 - DNA, 105 bp, Artificial Sequence
  Synthetic oligonucleotide
gagacggagtctcactctgtcacccaggctggagtgcagtggcacgatcttggctcactgcaacctccgcctcccaggttcaagtaattctcctgcctcagcctc

SEQ ID NO: 2645 - DNA, 47 bp, Artificial Sequence
  Synthetic oligonucleotide
accaccgccagtcctcccaccacatccatcacccactgtccacccac

SEQ ID NO: 2646 - DNA, 31 bp, Artificial Sequence
  Synthetic oligonucleotide
ctgcctccggatgcacgccgccgcaagacac

SEQ ID NO: 2647 - DNA, 80 bp, Artificial Sequence
  Synthetic oligonucleotide
gtgcgctgggtgcgggctcctagggcatgtcggcagggccctggcctggtcactcctgcccatgtgggtccctgttacag

SEQ ID NO: 2648 - DNA, 70 bp, Artificial Sequence
  Synthetic oligonucleotide
ttctttctccaagaggatgacagtgctgaccggaaggcagagaggaccagtccatcttcccctgcaccac

SEQ ID NO: 2649 - DNA, 49 bp, Artificial Sequence
  Synthetic oligonucleotide
tgccccaccaggaggcgactcctcgggcctccaaaggggcccaggctgg

SEQ ID NO: 2650 - DNA, 37 bp, Artificial Sequence
  Synthetic oligonucleotide
cagacgctggccacggccgacctagacctcatgaaga

SEQ ID NO: 2651 - DNA, 115 bp, Artificial Sequence
  Synthetic oligonucleotide
cgtgagctgccgcctccagcaccaccagctggcatcacccgctccaagtccaagcacgagctgaaactgctggagaagattcctgagaatgccgaggccacggtggtccttgtgg

SEQ ID NO: 2652 - DNA, 107 bp, Artificial Sequence
  Synthetic oligonucleotide
gctgcgtggagttcctctcccgccccaccatggcctttgtgcggctccgggaggctgtggagttggacgcagtgttggaggtgccggtgcctgtgcgtttcctcttc

SEQ ID NO: 2653 - DNA, 78 bp, Artificial Sequence
  Synthetic oligonucleotide
ctgctgctgggcccgagtagtgccaacatggactaccacgagatcggccgctccatctccaccctcatgtcagacaag

SEQ ID NO: 2654 - DNA, 15 bp, Artificial Sequence
  Synthetic oligonucleotide
ctcaagaagcgagag

SEQ ID NO: 2655 - DNA, 25 bp, Artificial Sequence
  Synthetic oligonucleotide
gagcagggccggctgctacctacag

SEQ ID NO: 2656 - DNA, 36 bp, Artificial Sequence
  Synthetic oligonucleotide
gggctgggctggagcccaaatctgcccaagataagg

SEQ ID NO: 2657 - DNA, 11 bp, Artificial Sequence
  Synthetic oligonucleotide
cgctcctgcag

SEQ ID NO: 2658 - DNA, 56 bp, Artificial Sequence
  Synthetic oligonucleotide
atggtagaggcggcaggggcagctgaagatgatccccttcggcggacggggcggcc

SEQ ID NO: 2659 - DNA, 42 bp, Artificial Sequence
  Synthetic oligonucleotide
ctttggggggctgatccgagatgtgcggcgccgctatcccca

SEQ ID NO: 2660 - DNA, 107 bp, Artificial Sequence
  Synthetic oligonucleotide
ctacctgagtgacttccgagatgcacttgaccctcagtgcctggccgcagtcatcttcatctactttgccgccctgtctcctgccatcacctttggggggctgctgg

SEQ ID NO: 2661 - DNA, 8 bp, Artificial Sequence
  Synthetic oligonucleotide
ttctgtag

SEQ ID NO: 2662 - DNA, 19 bp, Artificial Sequence
  Synthetic oligonucleotide
cagcaaccacctggagtac

SEQ ID NO: 2663 - DNA, 48 bp, Artificial Sequence
  Synthetic oligonucleotide
ctggtgggccgtgtgtggatcggcttctggctggtgttcctggccctg

SEQ ID NO: 2664 - DNA, 87 bp, Artificial Sequence
  Synthetic oligonucleotide
ctgctgtcgctggtgctcatggccggcaccttcttcatcgccttcttcctgcgcaaattcaagaacagccggttctttcctggccgg

SEQ ID NO: 2665 - DNA, 105 bp, Artificial Sequence
  Synthetic oligonucleotide
gtgcgtgggcttaaaggccaagagggggttaggggcaggaaggggggtggcaggaagtcagcggctgtggtggcaggactctgagcgctgtgcctgcccactcag

SEQ ID NO: 2666 - DNA, 90 bp, Artificial Sequence
  Synthetic oligonucleotide
atccggcgggtgattggggactttggggtgcccatcgccatcctcatcatggtgcttgtggattacagtattgaggacacctatacccag

SEQ ID NO: 2667 - DNA, 88 bp, Artificial Sequence
  Synthetic oligonucleotide
aagctgagcgttcccagtggattctcggtgactgccccagaaaagaggggctgggtcatcaaccccctgggagagaagagccccttcc

SEQ ID NO: 2668 - DNA, 79 bp, Artificial Sequence
  Synthetic oligonucleotide
ctgtgtggatgatggttgccagcctgctgcccgccatcctggtcttcattctcatcttcatggagacacagatcaccac

SEQ ID NO: 2669 - DNA, 97 bp, Artificial Sequence
  Synthetic oligonucleotide
gtccggaccctccgtatgcacctgttcacggccctgcagctgctctgcctggccctgctctgggccgtcatgtccacagctgcctccctggccttcc

SEQ ID NO: 2670 - DNA, 21 bp, Artificial Sequence
  Synthetic oligonucleotide
ccttcatcctcatcctcacag

SEQ ID NO: 2671 - DNA, 56 bp, Artificial Sequence
  Synthetic oligonucleotide
tgccgctccgcatggtggtgctcacccgtatcttcaccgaccgagagatgaaatgt

SEQ ID NO: 2672 - DNA, 100 bp, Artificial Sequence
  Synthetic oligonucleotide
gtaagccctcccgtctgcctcccccggttcctcttgcctccctgtggatctggaaaggcccccccacttcccttcttgaccgccacctccccacacacag

SEQ ID NO: 2673 - DNA, 97 bp, Artificial Sequence
  Synthetic oligonucleotide
catgcccctccctcctttttatttaagtgaataatttaaagtcttctcctcccccactgcccctgcagtaaagtgctttggcccccacctaaaatgt

SEQ ID NO: 2674 - DNA, 2723 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcagctgaacccaccgtgtaaccagcacccacccacccagatcaatcataaaccgaaccgcaccagcaccccagcagcccgttcccgtttccgtaccctccacgtggagcctccgttctgtctcccaacgccctgggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 2675 - DNA, 2630 bp, Homo sapiens
gggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 2676 - DNA, 1931 bp, Homo sapiens
ctccgtgctttctttttagaggggatgatttgaggtagagatgaaaaacggggttaggacgagtcacacctgaattcacatcctggcaaatcccaccgtgggcttccccacactaggcctcagttgctccatctgtaaacaggactgatcatattcctctctgcccagcattgctgttcaggggaaaagagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccagcagcagtgttgtggggctggggagcagatcttcctcccctcctccctcaccgaggcctttgccttggtgtcccaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 2677 - DNA, 187 bp, Artificial Sequence
  Synthetic oligonucleotide
gggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcag

SEQ ID NO: 2678 - DNA, 148 bp, Artificial Sequence
  Synthetic oligonucleotide
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcag

SEQ ID NO: 2679 - DNA, 132 bp, Artificial Sequence
  Synthetic oligonucleotide
ctgaacccaccgtgtaaccagcacccacccacccagatcaatcataaaccgaaccgcaccagcaccccagcagcccgttcccgtttccgtaccctccacgtggagcctccgttctgtctcccaacgccctgg

SEQ ID NO: 2680 - DNA, 165 bp, Artificial Sequence
  Synthetic oligonucleotide
gattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccag

SEQ ID NO: 2681 - DNA, 120 bp, Artificial Sequence
  Synthetic oligonucleotide
agaaagagaaagaccccaagtactggcgagaccaagcgcaagagacactgaaatatgccctggagcttcagaagctcaacaccaacgtggctaagaatgtcatcatgttcctgggagatg

SEQ ID NO: 2682 - DNA, 175 bp, Artificial Sequence
  Synthetic oligonucleotide
acgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctg

SEQ ID NO: 2683 - DNA, 176 bp, Artificial Sequence
  Synthetic oligonucleotide
ggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgac

SEQ ID NO: 2684 - DNA, 144 bp, Artificial Sequence
  Synthetic oligonucleotide
gtgatcatggggggtggccggaaatacatgtaccccaagaataaaactgatgtggagtatgagagtgacgagaaagccaggggcacgaggctggacggcctggacctcgttgacacctggaagagcttcaaaccgagatacaag

SEQ ID NO: 2685 - DNA, 135 bp, Artificial Sequence
  Synthetic oligonucleotide
gtctcttcgagccaggggacatgcagtacgagctgaacaggaacaacgtgacggacccgtcactctccgagatggtggtggtggccatccagatcctgcggaagaaccccaaaggcttcttcttgctggtggaag

SEQ ID NO: 2686 - DNA, 516 bp, Artificial Sequence
  Synthetic oligonucleotide
ctccgtgctttctttttagaggggatgatttgaggtagagatgaaaaacggggttaggacgagtcacacctgaattcacatcctggcaaatcccaccgtgggcttccccacactaggcctcagttgctccatctgtaaacaggactgatcatattcctctctgcccagcattgctgttcaggggaaaagagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccagcag

SEQ ID NO: 2687 - DNA, 120 bp, Artificial Sequence
  Synthetic oligonucleotide
gtctggcccccatgctgagtgacacagacaagaagcccttcactgccatcctgtatggcaatgggcctggctacaaggtggtgggcggtgaacgagagaatgtctccatggtggactatg

SEQ ID NO: 2688 - DNA, 363 bp, Artificial Sequence
  Synthetic oligonucleotide
ctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcag

SEQ ID NO: 2689 - DNA, 557 bp, Artificial Sequence
  Synthetic oligonucleotide
ctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 2690 - DNA, 116 bp, Artificial Sequence
  Synthetic oligonucleotide
ggatgggtgtctccacagtgacggctgcccgcatcctcaagggtcagctccaccacaaccctggggaggagaccaggctggagatggacaagttccccttcgtggccctctccaag

SEQ ID NO: 2691 - DNA, 70 bp, Artificial Sequence
  Synthetic oligonucleotide
cactcccacttcatctggaaccgcacggaactcctgacccttgacccccacaatgtggactacctattgg

SEQ ID NO: 2692 - DNA, 73 bp, Artificial Sequence
  Synthetic oligonucleotide
cagtgttgtggggctggggagcagatcttcctcccctcctccctcaccgaggcctttgccttggtgtcccaag

SEQ ID NO: 2693 - DNA, 71 bp, Artificial Sequence
  Synthetic oligonucleotide
gaggcagaattgaccacgggcaccatgaaggaaaagccaagcaggccctgcatgaggcggtggagatggac

SEQ ID NO: 2694 - DNA, 66 bp, Artificial Sequence
  Synthetic oligonucleotide
cgggccatcgggcaggcaggcagcttgacctcctcggaagacactctgaccgtggtcactgcggac

SEQ ID NO: 2695 - DNA, 55 bp, Artificial Sequence
  Synthetic oligonucleotide
cattcccacgtcttcacatttggtggatacaccccccgtggcaactctatctttg

SEQ ID NO: 2696 - DNA, 110 bp, Artificial Sequence
  Synthetic oligonucleotide
cctctgcaactgcaagaaaggggacccaggaaaccaaagtctgccgcccacctcgctcccctctggaatcttccccaagggccaaacccacttctggcctccagcctttg

SEQ ID NO: 2697 - DNA, 2021 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2698 - DNA, 2632 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataatgctgctcattgtgattcttacctataagcagcctaatttgaattatttgctgcaatcaagagaagtgtacaatagttttattacttttttagtgtacttctatcctttttccaactatatctcctctatttttcctcctcgttaacaggctagaatgtgcattcctgggttaccgatttttacactcaattggatgtgtaatgagggatctatctaatccatcttgtcttggaaattttgcactctagaagaaagtgtgtcactttcttcagcagcgagaccttttaagattggtggtttggttgtcctgttctgtggtctttggtggaagccagtttgttgtaagagaatgtagagcttattaatgtaagtcatttggggttatattgtggagggttgtttaggattgcatggcaggaattgggtaaatgaaaggtaacactaaagattggagatggtataatggcatatctacaggtctgtgtttccttatctgcgaagtgagacattgaaatagatctgttttgcaaattgtggattgcaaccctttagtgatttacgaccagcattaatcactaacccctttcctaccccagtgtaaaacag

SEQ ID NO: 2699 - DNA, 2119 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2700 - DNA, 1910 bp, Homo sapiens
cctctttctttcgcgctctagccacccgggaaggcctgcccagcgtagctgggctctgattggctgctttgaaagtctacgggctacccgattggtgaatccggggccctttagcgcggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2701 - DNA, 1962 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggatctaccatacccattgactaactatggaagattataccaaaatagagaaaattggagaagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2702 - DNA, 2055 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagatggagcatctgtattactttccaatttcaaactagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2703 - DNA, 1850 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2704 - DNA, 2374 bp, Homo sapiens
agcattagtttttgttttttatctgacaggtagctatggatattctgagggagaagccaggattaatacacatttttttttttaagttgctgaattgtagtggctctcctttctagcatttttgtcactattgagccctcttagtttatgctagacgtgtttttcttattggttgatattttaaattattaaagccatcttctgaataagctttattcgcactttgtacctagtttctccatcagaaggatctattgctataccattgtatacattttctcattggtcttcgggttactttcagagtgtaaagactccttatgccacaaaattaagcttagatttcccccaaatcaaatactataaatcagattccttagtctagccacaattgacatatcttggagtggataaatctttgttgctggcattgttctgtgcatcataacttgtttagtggcatgtcatcactgtcttctactctctagatgccattagtatactcttcacagttaggacaaccaaaagtgtctccagatattgccaaatgtctcctgatgggcaaagtctatcccagttgcgaaccattattgtaaattaaacttggtttcaaatttgagctttattccttagctctgggaacttgggcaagttacttcccttcgagcctcaatgtcctcatttgtaaaatgacattaatacctacttttagctgtgggaattgagtaccatgatttatacaaagcagtttgtatggtgctggttacatgagagttcagatggtaactagttagtaaaaaatctctagtgtgcttgttgattttattttattttagtatttcttaaagatcaaatttaacatcaatcctaaactttatttagctttttctggcgcgtaaactaacatactaagttgtgtgactataattcatttagtgactcatttttagctatttttataacacattgtgctatggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaa

SEQ ID NO: 2705 - DNA, 157 bp, Artificial Sequence
  Synthetic oligonucleotide
gtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcag

SEQ ID NO: 2706 - DNA, 124 bp, Artificial Sequence
  Synthetic oligonucleotide
tcttcaggatgtgcttatgcaggattccaggttatatctcatctttgagtttctttccatggatctgaagaaatacttggattctatccctcctggtcagtacatggattcttcacttgttaag

SEQ ID NO: 2707 - DNA, 164 bp, Artificial Sequence
  Synthetic oligonucleotide
gtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcag

SEQ ID NO: 2708 - DNA, 142 bp, Artificial Sequence
  Synthetic oligonucleotide
agctttgggcactcccaataatgaagtgtggccagaagtggaatctttacaggactataagaatacatttcccaaatggaaaccaggaagcctagcatcccatgtcaaaaacttggatgaaaatggcttggatttgctctcg

SEQ ID NO: 2709 - DNA, 1402 bp, Artificial Sequence
  Synthetic oligonucleotide
agcattagtttttgttttttatctgacaggtagctatggatattctgagggagaagccaggattaatacacatttttttttttaagttgctgaattgtagtggctctcctttctagcatttttgtcactattgagccctcttagtttatgctagacgtgtttttcttattggttgatattttaaattattaaagccatcttctgaataagctttattcgcactttgtacctagtttctccatcagaaggatctattgctataccattgtatacattttctcattggtcttcgggttactttcagagtgtaaagactccttatgccacaaaattaagcttagatttcccccaaatcaaatactataaatcagattccttagtctagccacaattgacatatcttggagtggataaatctttgttgctggcattgttctgtgcatcataacttgtttagtggcatgtcatcactgtcttctactctctagatgccattagtatactcttcacagttaggacaaccaaaagtgtctccagatattgccaaatgtctcctgatgggcaaagtctatcccagttgcgaaccattattgtaaattaaacttggtttcaaatttgagctttattccttagctctgggaacttgggcaagttacttcccttcgagcctcaatgtcctcatttgtaaaatgacattaatacctacttttagctgtgggaattgagtaccatgatttatacaaagcagtttgtatggtgctggttacatgagagttcagatggtaactagttagtaaaaaatctctagtgtgcttgttgattttattttattttagtatttcttaaagatcaaatttaacatcaatcctaaactttatttagctttttctggcgcgtaaactaacatactaagttgtgtgactataattcatttagtgactcatttttagctatttttataacacattgtgctatggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccag

SEQ ID NO: 2710 - DNA, 278 bp, Artificial Sequence
  Synthetic oligonucleotide
ctcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttag

SEQ ID NO: 2711 - DNA, 197 bp, Artificial Sequence
  Synthetic oligonucleotide
gtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgcc

SEQ ID NO: 2712 - DNA, 842 bp, Artificial Sequence
  Synthetic oligonucleotide
ttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataatgctgctcattgtgattcttacctataagcagcctaatttgaattatttgctgcaatcaagagaagtgtacaatagttttattacttttttagtgtacttctatcctttttccaactatatctcctctatttttcctcctcgttaacaggctagaatgtgcattcctgggttaccgatttttacactcaattggatgtgtaatgagggatctatctaatccatcttgtcttggaaattttgcactctagaagaaagtgtgtcactttcttcagcagcgagaccttttaagattggtggtttggttgtcctgttctgtggtctttggtggaagccagtttgttgtaagagaatgtagagcttattaatgtaagtcatttggggttatattgtggagggttgtttaggattgcatggcaggaattgggtaaatgaaaggtaacactaaagattggagatggtataatggcatatctacaggtctgtgtttccttatctgcgaagtgagacattgaaatagatctgttttgcaaattgtggattgcaaccctttagtgatttacgaccagcattaatcactaacccctttcctaccccagtgtaaaacag

SEQ ID NO: 2713 - DNA, 118 bp, Artificial Sequence
  Synthetic oligonucleotide
cctctttctttcgcgctctagccacccgggaaggcctgcccagcgtagctgggctctgattggctgctttgaaagtctacgggctacccgattggtgaatccggggccctttagcgcg

SEQ ID NO: 2714 - DNA, 111 bp, Artificial Sequence
  Synthetic oligonucleotide
gtgagtttgaaactgctcgcacttggcttcaaagctggctcttggaaattgagcggagagcgacgcggttgttgtagctgccgctgcggccgccgcggaataataagccgg

SEQ ID NO: 2715 - DNA, 98 bp, Artificial Sequence
  Synthetic oligonucleotide
gtacagtggctggggtcagggtcgtgtctaggggacggccgagggcctcggagggcgagtattgaggaacggggtcctctaagaaggccggactggag

SEQ ID NO: 2716 - DNA, 62 bp, Artificial Sequence
  Synthetic oligonucleotide
gatctaccatacccattgactaactatggaagattataccaaaatagagaaaattggagaag

SEQ ID NO: 2717 - DNA, 34 bp, Artificial Sequence
  Synthetic oligonucleotide
atggagcatctgtattactttccaatttcaaact

SEQ ID NO: 2718 - DNA, 81 bp, Artificial Sequence
  Synthetic oligonucleotide
agttatttataccaaatcctacaggggattgtgttttgtcactctagaagagttcttcacagagacttaaaacctcaaaat

SEQ ID NO: 2719 - DNA, 53 bp, Artificial Sequence
  Synthetic oligonucleotide
ctcttgattgatgacaaaggaacaattaaactggctgattttggccttgccag

SEQ ID NO: 2720 - DNA, 37 bp, Artificial Sequence
  Synthetic oligonucleotide
agcttttggaatacctatcagagtatatacacatgag

SEQ ID NO: 2721 - DNA, 103 bp, Artificial Sequence
  Synthetic oligonucleotide
aaaatgttaatctatgatccagccaaacgaatttctggcaaaatggcactgaatcatccatattttaatgatttggacaatcagattaagaagatgtagcttt

SEQ ID NO: 2722 - DNA, 55 bp, Artificial Sequence
  Synthetic oligonucleotide
ctgacaaaaagtttccatatgttatgtcaacagatagttgtgtttttattgttaa

SEQ ID NO: 2723 - DNA, 54 bp, Artificial Sequence
  Synthetic oligonucleotide
gaaaatgctaagttcaagtttcgtaatgctttgaagtatttttatgctctgaat

SEQ ID NO: 2724 - DNA, 54 bp, Artificial Sequence
  Synthetic oligonucleotide
aaaatttgctaagtcttacaaagatcaagggctgtccgcaacagggaagaacag

SEQ ID NO: 2725 - DNA, 2294 bp, Homo sapiens
ctcaggcagaatgctgtcccctctgaatcattctttttgttaaggattaaaaaaaaagccacccccaaaaggcacaacccaccctggagagatcagagataactaagcttgtgggaaacagaagtgtagttggcaccaagtcagagggtggggaagggaggagagaagataaccagcccctatggaggtgtataaaaggtgtccactctggggaagagccacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggtaagggaacagccccgtggtgtagggggaggcagagttagcctcccattcactgccccaatgggggtgggagctggcggggagggagggagccagtgctgggctctccagtgtagggagggggagagctggggtggaagtggtcattcgctcactgattttccttttgaaactgatggctctgccccacagagctatttggctgtcttgggaagagccatctttggggacaataaagagtctccatccacgcaccacctgactaatgaggagtttgtgagccctccaggggggccctgccctgtcctgaggtgggtcttctccagcctgagcatgtcttgtctcttgtttcccaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaa

SEQ ID NO: 2726 - DNA, 2127 bp, Homo sapiens
ctcaggcagaatgctgtcccctctgaatcattctttttgttaaggattaaaaaaaaagccacccccaaaaggcacaacccaccctggagagatcagagataactaagcttgtgggaaacagaagtgtagttggcaccaagtcagagggtggggaagggaggagagaagataaccagcccctatggaggtgtataaaaggtgtccactctggggaagagccacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaattgcaggctgccctgggctcaacaacctccagtgagaaggaggagccctcccctgcaactggacacagtcctccactgtgggacctggaaacactctccagaacactctgccagcactcagagccaaggagagggaggatgagtagcctcacacatcttcctttcccatccccacaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaa

SEQ ID NO: 2727 - DNA, 563 bp, Homo sapiens
tcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacataaaaa

SEQ ID NO: 2728 - DNA, 198 bp, Artificial Sequence
  Synthetic oligonucleotide
ctcaggcagaatgctgtcccctctgaatcattctttttgttaaggattaaaaaaaaagccacccccaaaaggcacaacccaccctggagagatcagagataactaagcttgtgggaaacagaagtgtagttggcaccaagtcagagggtggggaagggaggagagaagataaccagcccctatggaggtgtataaaag

SEQ ID NO: 2729 - DNA, 189 bp, Artificial Sequence
  Synthetic oligonucleotide
gagatgaaggaattgcaggctgccctgggctcaacaacctccagtgagaaggaggagccctcccctgcaactggacacagtcctccactgtgggacctggaaacactctccagaacactctgccagcactcagagccaaggagagggaggatgagtagcctcacacatcttcctttcccatccccacag

SEQ ID NO: 2730 - DNA, 177 bp, Artificial Sequence
  Synthetic oligonucleotide
tcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacag

SEQ ID NO: 2731 - DNA, 356 bp, Artificial Sequence
  Synthetic oligonucleotide
gtaagggaacagccccgtggtgtagggggaggcagagttagcctcccattcactgccccaatgggggtgggagctggcggggagggagggagccagtgctgggctctccagtgtagggagggggagagctggggtggaagtggtcattcgctcactgattttccttttgaaactgatggctctgccccacagagctatttggctgtcttgggaagagccatctttggggacaataaagagtctccatccacgcaccacctgactaatgaggagtttgtgagccctccaggggggccctgccctgtcctgaggtgggtcttctccagcctgagcatgtcttgtctcttgtttcccag

SEQ ID NO: 2732 - DNA, 138 bp, Artificial Sequence
  Synthetic oligonucleotide
atggtgggccctctgtgctcttctcttcctgtcggatctctctcctctctgacctggatacgctttggtttctcaacttctctaccccaaagaaaagattattcaataaagtttcctgcctttctgcaaacataaaaa

SEQ ID NO: 2733 - DNA, 104 bp, Artificial Sequence
  Synthetic oligonucleotide
gtgtccactctggggaagagccacagtcctcggcccaggccaagcaagcttctatctgcacctgctctcaatcctgctctcaccatgagcctccgcctgcagag

SEQ ID NO: 2734 - DNA, 62 bp, Artificial Sequence
  Synthetic oligonucleotide
ctcctctgccagctatggaggtggtttcgggggtggctcttgccagctgggaggaggccgtg

SEQ ID NO: 2735 - DNA, 22 bp, Artificial Sequence
  Synthetic oligonucleotide
gtgtctctacctgttcaactcg

SEQ ID NO: 2736 - DNA, 30 bp, Artificial Sequence
  Synthetic oligonucleotide
gtttgtgtctgggggatcagctgggggcta

SEQ ID NO: 2737 - DNA, 41 bp, Artificial Sequence
  Synthetic oligonucleotide
tggaggcggcgtgagctgtggttttggtggaggggctggta

SEQ ID NO: 2738 - DNA, 4 bp, Artificial Sequence
  Synthetic oligonucleotide
gtgg

SEQ ID NO: 2739 - DNA, 8 bp, Artificial Sequence
  Synthetic oligonucleotide
ctttggag

SEQ ID NO: 2740 - DNA, 36 bp, Artificial Sequence
  Synthetic oligonucleotide
gtggctatggaggtggccttggaggtggctatggag

SEQ ID NO: 2741 - DNA, 12 bp, Artificial Sequence
  Synthetic oligonucleotide
gtggccttggag

SEQ ID NO: 2742 - DNA, 80 bp, Artificial Sequence
  Synthetic oligonucleotide
gtggctttggtgggggttttgctggtggctttgttgactttggtgcttgtgatggcggcctcctcactggcaatgagaag

SEQ ID NO: 2743 - DNA, 31 bp, Artificial Sequence
  Synthetic oligonucleotide
atcaccatgcagaacctcaacgaccgcctgg

SEQ ID NO: 2744 - DNA, 74 bp, Artificial Sequence
  Synthetic oligonucleotide
cttcctacctggagaaggtgcgcgccctggaggaggccaacgctgacctggaggtgaagatccgtgactggcac

SEQ ID NO: 2745 - DNA, 75 bp, Artificial Sequence
  Synthetic oligonucleotide
ctgaagcagagcccagctagccctgagcgggactacagcccctactacaagaccattgaagagctccgggacaag

SEQ ID NO: 2746 - DNA, 36 bp, Artificial Sequence
  Synthetic oligonucleotide
atcctgaccgccaccattgaaaacaaccgggtcatc

SEQ ID NO: 2747 - DNA, 47 bp, Artificial Sequence
  Synthetic oligonucleotide
ctggagattgacaatgccaggctggctgtggacgacttcaggctcaa

SEQ ID NO: 2748 - DNA, 30 bp, Artificial Sequence
  Synthetic oligonucleotide
gtatgagaatgagctggccctgcgccagag

SEQ ID NO: 2749 - DNA, 76 bp, Artificial Sequence
  Synthetic oligonucleotide
cgtggaggccgacatcaacggcctgcgccgggtgctggatgagctcactctgtctaagactgacctggagatgcag

SEQ ID NO: 2750 - DNA, 51 bp, Artificial Sequence
  Synthetic oligonucleotide
atcgagagcctgaatgaagagctagcctacatgaagaagaaccatgaagag

SEQ ID NO: 2751 - DNA, 93 bp, Artificial Sequence
  Synthetic oligonucleotide
gagatgaaggaatttagcaaccaggtggtcggccaggtcaacgtggagatggatgccaccccaggcattgacctgacccgcgtgctggcagag

SEQ ID NO: 2752 - DNA, 20 bp, Artificial Sequence
  Synthetic oligonucleotide
atgagggagcagtacgaggc

SEQ ID NO: 2753 - DNA, 8 bp, Artificial Sequence
  Synthetic oligonucleotide
catggcag

SEQ ID NO: 2754 - DNA, 41 bp, Artificial Sequence
  Synthetic oligonucleotide
agaggaaccgccgggatgctgaggaatggttccacgccaag

SEQ ID NO: 2755 - DNA, 72 bp, Artificial Sequence
  Synthetic oligonucleotide
agtgcagagctgaacaaggaggtgtctaccaacactgccatgattcagaccagcaagacagagatcacggag

SEQ ID NO: 2756 - DNA, 27 bp, Artificial Sequence
  Synthetic oligonucleotide
ctcaggcgcacgctccaaggcctggag

SEQ ID NO: 2757 - DNA, 27 bp, Artificial Sequence
  Synthetic oligonucleotide
attgagctgcagtcccagctgagcatg

SEQ ID NO: 2758 - DNA, 25 bp, Artificial Sequence
  Synthetic oligonucleotide
aaagcggggctggagaacacggtgg

SEQ ID NO: 2759 - DNA, 29 bp, Artificial Sequence
  Synthetic oligonucleotide
cagagacggagtgccgctatgccctgcag

SEQ ID NO: 2760 - DNA, 6 bp, Artificial Sequence
  Synthetic oligonucleotide
ctgcag

SEQ ID NO: 2761 - DNA, 46 bp, Artificial Sequence
  Synthetic oligonucleotide
cagatccagggactcatcagcagcatcgaggcccagctgagcgagc

SEQ ID NO: 2762 - DNA, 71 bp, Artificial Sequence
  Synthetic oligonucleotide
tccgcagtgagatggagtgccagaaccaagagtacaagatgctgctggacatcaagacacgtctggagcag

SEQ ID NO: 2763 - DNA, 44 bp, Artificial Sequence
  Synthetic oligonucleotide
gagatcgccacctaccgcagcctgctcgagggccaggacgccaa

SEQ ID NO: 2764 - DNA, 26 bp, Artificial Sequence
  Synthetic oligonucleotide
gatgattggtttcccttcctcagcag

SEQ ID NO: 2765 - DNA, 14 bp, Artificial Sequence
  Synthetic oligonucleotide
gaagcgtcagcccc

SEQ ID NO: 2766 - DNA, 8 bp, Artificial Sequence
  Synthetic oligonucleotide
cgtagcac

SEQ ID NO: 2767 - DNA, 9 bp, Artificial Sequence
  Synthetic oligonucleotide
ctctgttac

SEQ ID NO: 2768 - DNA, 15 bp, Artificial Sequence
  Synthetic oligonucleotide
cacgacttctagtgc

SEQ ID NO: 2769 - DNA, 102 bp, Artificial Sequence
  Synthetic oligonucleotide
ctctgttaccaccacctctaatgcctctggtcgccgcacttctgatgtccgtaggccttaaatctgcctggcgtcccctccctctgtcttcagcacccagag

SEQ ID NO: 2770 - DNA, 27 bp, Artificial Sequence
  Synthetic oligonucleotide
gaggagagagccggcagttccctgcag

SEQ ID NO: 2771 - DNA, 38 bp, Artificial Sequence
  Synthetic oligonucleotide
gagagaggaggggctgctggacccaaggctcagtccct

SEQ ID NO: 2772 - DNA, 35 bp, Artificial Sequence
  Synthetic oligonucleotide
ctgctctcaggaccccctgtcctgactctctcctg

SEQ ID NO: 2773 - DNA, 1446 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcctctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaatattcttcaattttgtctctatctatctatctatcatctaatctataatatgtttttttttccttcccctttaggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaaaactgaattatcatttttc

SEQ ID NO: 2774 - DNA, 394 bp, Artificial Sequence
  Synthetic oligonucleotide
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccacagtcaaccgccctgaacacatcctgcaaaaagcccagagaaag

SEQ ID NO: 2775 - DNA, 416 bp, Artificial Sequence
  Synthetic oligonucleotide
gtaagaacctcaagatccccagaagctttctaacagcccaatcagagaaatgttcatagagcccacccatggaatttaatgccaaaggtgtctaatgacccagcctctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaatattcttcaattttgtctctatctatctatctatcatctaatctataatatgtttttttttccttcccctttag

SEQ ID NO: 2776 - DNA, 155 bp, Artificial Sequence
  Synthetic oligonucleotide
tacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaagga

SEQ ID NO: 2777 - DNA, 48 bp, Artificial Sequence
  Synthetic oligonucleotide
gagcgccatggattactacagaaaatatgcagctatctttctggtcac

SEQ ID NO: 2778 - DNA, 47 bp, Artificial Sequence
  Synthetic oligonucleotide
attgtcggtgtttctgcatgttctccattccgctcctgatgtgcagg

SEQ ID NO: 2779 - DNA, 23 bp, Artificial Sequence
  Synthetic oligonucleotide
attgcccagaatgcacgctacag

SEQ ID NO: 2780 - DNA, 22 bp, Artificial Sequence
  Synthetic oligonucleotide
gaaaacccattcttctcccagc

SEQ ID NO: 2781 - DNA, 55 bp, Artificial Sequence
  Synthetic oligonucleotide
cgggtgccccaatacttcagtgcatgggctgctgcttctctagagcatatcccac

SEQ ID NO: 2782 - DNA, 85 bp, Artificial Sequence
  Synthetic oligonucleotide
tccactaaggtccaagaagacgatgttggtccaaaagaacgtcacctcagagtccacttgctgtgtagctaaatcatataacagg

SEQ ID NO: 2783 - DNA, 53 bp, Artificial Sequence
  Synthetic oligonucleotide
gtcacagtaatggggggtttcaaagtggagaaccacacggcgtgccactgcag

SEQ ID NO: 2784 - DNA, 38 bp, Artificial Sequence
  Synthetic oligonucleotide
tatactgcagctttactgccttcctccttatcctacag

SEQ ID NO: 2785 - DNA, 15 bp, Artificial Sequence
  Synthetic oligonucleotide
tacaatcagcagtct

SEQ ID NO: 2786 - DNA, 95 bp, Artificial Sequence
  Synthetic oligonucleotide
agttcttttcatttggaatgaatacagcatttagcttgttccactgcaaataaagccttttaaatcatcattcaaaaactgaattatcatttttc

SEQ ID NO: 2787 - DNA, 2002 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2788 - DNA, 2849 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaacgtaagtatctgcgtggcttcggccctgggggttgggtgcatgggacaggcagcccacctgcacgttgctggggcagggtccccaggagctccaggagttgatggctgtccctcagcagggagaagtgactcattagcactgaggattgatactcaggaaaagatcaaatgagagagacactgtctggtctgatgggggtggggcagggaactggtccttaccttggagatcctagtctgatggaggagacaggtcccagctctggagattgtcatctgatgggaagataggaacatggtctcatgatctttgctcttgacagcttttggatgagcaaaaacagtcctgtctctggggtctgtagcctgatgggagatagggacatggtccttgtcctccaaattccaatctgatggagaatatatgatcctagccttagggttcctagtctaatggaggagataggggcctggtttttgtcttggcgatcccagtctgatgggggagatggtagaaaatctatgtcctagagactgcagagaaatggagacggatttcatggagtctacatggctcctccctggcaggacacactggatcagaatcaaataacccatctggggaggcaagactcacacagggccaccggcagagggatgggatggaagggaggtggtggcagggacaggagggatgtgtgtgcagtgtgatgtcgaggtgccagtggaggcactcacagcacctgggggaggatgagggagagagccggctcctgtccatgagggctagggggcaagcgagggcctcctggcccctacccactttaaattgcctgcttctcctgcagcggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2789 - DNA, 2088 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatggtaggaacagtcctgtgcatgggggagggcccagaagagggcattgaccatcctcactgacccctggtcttcctgccctcctgcagaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2790 - DNA, 1883 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccagactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2791 - DNA, 1984 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcacctccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2792 - DNA, 1985 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtgatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2793 - DNA, 1957 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2794 - DNA, 1942 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaaggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2795 - DNA, 1466 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2796 - DNA, 1696 bp, Homo sapiens
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgaggcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaaggtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2797 - DNA, 307 bp, Artificial Sequence
  Synthetic oligonucleotide
ctcttcagcacccagccccggggccagcaccgtgggtggagcagtgtggggtgaaagacagcaactttggcgggggggtcagctgacactgcaacccatttccccaccagacagggttgaggcgggccaggctggggtggtggctgcctgggagggcctggggacggtgacgtcctgccttctcctcttctccgtattaggtcatgggaaagcatagctggagggcccgcctgaatcacaggtgacgggcctgagaccagaggcacgcacacgcacggcactcagcacgaggatttggagaaatgag

SEQ ID NO: 2798 - DNA, 219 bp, Artificial Sequence
  Synthetic oligonucleotide
gcaaattcctgatgatgggcggggagggggcccccagccacctgggagctggcaggtggccagtggtgatgaaagcccaggggaatggaaacagaggagcaagcctgttgtaatcgctacgcccacttggtggcctataaaggaagcgggcgaaccccggcagccctacacaacttggggcccctctcctctccagcccttctcctgtgtgcctgcctc

SEQ ID NO: 2799 - DNA, 126 bp, Artificial Sequence
  Synthetic oligonucleotide
acagaggaactgaaccgcgaggtggccaccaacagtgagctggtgcagagtggcaagagtgagatctcggagctccggcgcaccatgcaggccttggagatagagctgcagtcccagctcagcatg

SEQ ID NO: 2800 - DNA, 705 bp, Artificial Sequence
  Synthetic oligonucleotide
gtaagtatctgcgtggcttcggccctgggggttgggtgcatgggacaggcagcccacctgcacgttgctggggcagggtccccaggagctccaggagttgatggctgtccctcagcagggagaagtgactcattagcactgaggattgatactcaggaaaagatcaaatgagagagacactgtctggtctgatgggggtggggcagggaactggtccttaccttggagatcctagtctgatggaggagacaggtcccagctctggagattgtcatctgatgggaagataggaacatggtctcatgatctttgctcttgacagcttttggatgagcaaaaacagtcctgtctctggggtctgtagcctgatgggagatagggacatggtccttgtcctccaaattccaatctgatggagaatatatgatcctagccttagggttcctagtctaatggaggagataggggcctggtttttgtcttggcgatcccagtctgatgggggagatggtagaaaatctatgtcctagagactgcagagaaatggagacggatttcatggagtctacatggctcctccctggcaggacacactggatcagaatcaaataacccatctggggaggcaagactcacacagggccaccggcagagggatgggatggaagggaggtggtggcagggacaggagggatgtgtgtgcag

SEQ ID NO: 2801 - DNA, 142 bp, Artificial Sequence
  Synthetic oligonucleotide
tgtgatgtcgaggtgccagtggaggcactcacagcacctgggggaggatgagggagagagccggctcctgtccatgagggctagggggcaagcgagggcctcctggcccctacccactttaaattgcctgcttctcctgcag

SEQ ID NO: 2802 - DNA, 127 bp, Artificial Sequence
  Synthetic oligonucleotide
ggaggcagccgccccatctgccccacagtctccggcctctccagcctcagccccctgcttcagtcccttccccatgcttccttgcctgatgacaataaagcttgttgactcagctaaaaaaaaaaaa

SEQ ID NO: 2803 - DNA, 49 bp, Artificial Sequence
  Synthetic oligonucleotide
ctgccgccgccaccatgaccacctccatccgccagttcacctcctccag

SEQ ID NO: 2804 - DNA, 15 bp, Artificial Sequence
  Synthetic oligonucleotide
ctccatcaagggctc

SEQ ID NO: 2805 - DNA, 7 bp, Artificial Sequence
  Synthetic oligonucleotide
ctccggc

SEQ ID NO: 2806 - DNA, 44 bp, Artificial Sequence
  Synthetic oligonucleotide
ctggggggcggctcgtcccgcacctcctgccggctgtctggcgg

SEQ ID NO: 2807 - DNA, 15 bp, Artificial Sequence
  Synthetic oligonucleotide
cctgggtgccggctc

SEQ ID NO: 2808 - DNA, 7 bp, Artificial Sequence
  Synthetic oligonucleotide
ctgcagg

SEQ ID NO: 2809 - DNA, 11 bp, Artificial Sequence
  Synthetic oligonucleotide
ctgggatctgc

SEQ ID NO: 2810 - DNA, 15 bp, Artificial Sequence
  Synthetic oligonucleotide
tggcggcctgggcag

SEQ ID NO: 2811 - DNA, 4 bp, Artificial Sequence
  Synthetic oligonucleotide
cacc

SEQ ID NO: 2812 - DNA, 18 bp, Artificial Sequence
  Synthetic oligonucleotide
ctcgggggtagcagctac

SEQ ID NO: 2813 - DNA, 70 bp, Artificial Sequence
  Synthetic oligonucleotide
tccagctgctacagctttggctctggtggtggctatggcagcagctttgggggtgttgatgggctgctgg

SEQ ID NO: 2814 - DNA, 41 bp, Artificial Sequence
  Synthetic oligonucleotide
ctggaggtgagaaggccaccatgcagaacctcaatgaccgc

SEQ ID NO: 2815 - DNA, 8 bp, Artificial Sequence
  Synthetic oligonucleotide
ctggcctc

SEQ ID NO: 2816 - DNA, 13 bp, Artificial Sequence
  Synthetic oligonucleotide
ctacctggacaag

SEQ ID NO: 2817 - DNA, 24 bp, Artificial Sequence
  Synthetic oligonucleotide
gtgcgtgccctggaggaggccaac

SEQ ID NO: 2818 - DNA, 6 bp, Artificial Sequence
  Synthetic oligonucleotide
actgag

SEQ ID NO: 2819 - DNA, 52 bp, Artificial Sequence
  Synthetic oligonucleotide
ctggaggtgaagatccgtgactggtaccagaggcaggccccggggcccgccc

SEQ ID NO: 2820 - DNA, 16 bp, Artificial Sequence
  Synthetic oligonucleotide
gtgactacagccagta

SEQ ID NO: 2821 - DNA, 19 bp, Artificial Sequence
  Synthetic oligonucleotide
ctacaggacaattgaggag

SEQ ID NO: 2822 - DNA, 12 bp, Artificial Sequence
  Synthetic oligonucleotide
ctgcagaacaag

SEQ ID NO: 2823 - DNA, 83 bp, Artificial Sequence
  Synthetic oligonucleotide
atcctcacagccaccgtggacaatgccaacatcctgctacagattgacaatgcccgtctggctgctgatgacttccgcaccaa

SEQ ID NO: 2824 - DNA, 25 bp, Artificial Sequence
  Synthetic oligonucleotide
gtttgagacagagcaggccctgcgc

SEQ ID NO: 2825 - DNA, 35 bp, Artificial Sequence
  Synthetic oligonucleotide
ctgagtgtggaggccgacatcaatggcctgcgcag

SEQ ID NO: 2826 - DNA, 34 bp, Artificial Sequence
  Synthetic oligonucleotide
ggtgctggatgagctgaccctggccagagccgac

SEQ ID NO: 2827 - DNA, 42 bp, Artificial Sequence
  Synthetic oligonucleotide
ctggagatgcagattgagaacctcaaggaggagctggcctac

SEQ ID NO: 2828 - DNA, 21 bp, Artificial Sequence
  Synthetic oligonucleotide
ctgaagaagaaccacgaggag

SEQ ID NO: 2829 - DNA, 24 bp, Artificial Sequence
  Synthetic oligonucleotide
gagatgaacgccctgcgaggccag

SEQ ID NO: 2830 - DNA, 7 bp, Artificial Sequence
  Synthetic oligonucleotide
gtgggtg

SEQ ID NO: 2831 - DNA, 17 bp, Artificial Sequence
  Synthetic oligonucleotide
gtgagatcaatgtggag

SEQ ID NO: 2832 - DNA, 18 bp, Artificial Sequence
  Synthetic oligonucleotide
atggacgctgccccaggc

SEQ ID NO: 2833 - DNA, 17 bp, Artificial Sequence
  Synthetic oligonucleotide
gtggacctgagccgcat

SEQ ID NO: 2834 - DNA, 27 bp, Artificial Sequence
  Synthetic oligonucleotide
cctcaacgagatgcgtgaccagtatga

SEQ ID NO: 2835 - DNA, 8 bp, Artificial Sequence
  Synthetic oligonucleotide
gaagatgg

SEQ ID NO: 2836 - DNA, 5 bp, Artificial Sequence
  Synthetic oligonucleotide
cagag

SEQ ID NO: 2837 - DNA, 39 bp, Artificial Sequence
  Synthetic oligonucleotide
aagaaccgcaaggatgccgaggattggttcttcagcaag

SEQ ID NO: 2838 - DNA, 86 bp, Artificial Sequence
  Synthetic oligonucleotide
gtaggaacagtcctgtgcatgggggagggcccagaagagggcattgaccatcctcactgacccctggtcttcctgccctcctgcag

SEQ ID NO: 2839 - DNA, 34 bp, Artificial Sequence
  Synthetic oligonucleotide
aaagcatccctggagggcaacctggcggagacag

SEQ ID NO: 2840 - DNA, 35 bp, Artificial Sequence
  Synthetic oligonucleotide
agaaccgctactgcgtgcagctgtcccagatccag

SEQ ID NO: 2841 - DNA, 27 bp, Artificial Sequence
  Synthetic oligonucleotide
gggctgattggcagcgtggaggagcag

SEQ ID NO: 2842 - DNA, 51 bp, Artificial Sequence
  Synthetic oligonucleotide
ctggcccagcttcgctgcgagatggagcagcagaaccaggaatacaaaatc

SEQ ID NO: 2843 - DNA, 30 bp, Artificial Sequence
  Synthetic oligonucleotide
ctgctggatgtgaagacgcggctggagcag

SEQ ID NO: 2844 - DNA, 21 bp, Artificial Sequence
  Synthetic oligonucleotide
gagattgccacctaccgccgc

SEQ ID NO: 2845 - DNA, 23 bp, Artificial Sequence
  Synthetic oligonucleotide
ctgctggagggagaggatgccca

SEQ ID NO: 2846 - DNA, 23 bp, Artificial Sequence
  Synthetic oligonucleotide
cctgactcagtacaagaaagaac

SEQ ID NO: 2847 - DNA, 71 bp, Artificial Sequence
  Synthetic oligonucleotide
cggtgaccacccgtcaggtgcgtaccattgtggaagaggtccaggatggcaaggtcatctcctcccgcgag

SEQ ID NO: 2848 - DNA, 25 bp, Artificial Sequence
  Synthetic oligonucleotide
caggtccaccagaccacccgctgag

SEQ ID NO: 2849 - DNA, 35 bp, Artificial Sequence
  Synthetic oligonucleotide
gactcagctaccccggccggccacccaggaggcag

SEQ ID NO: 2850 - DNA, 2840 bp, Homo sapiens
tgattattttcattttaaaaaaaggaaaaagttttattacgaaactagtttgtataaaacagggttatacatatttttgtaagtttgtaataaaacagtaagaaaaaaaaggcagtaatagaaatctccaaaaggcaacctatcaaaaccaactggctgccactttgagtttggacagtagctgcataaactttgttcttcttgaacagtatttaataacatcattaatacattaacaacatttctataaagtaagacacattggtgctgaagtacaactggtggcctcttgatctcacctatgaggagagttctttacaaaaccacatagggaaaattgcagttgtaaggtgaactacacatctaaaatatgcagaggtaatagcattacatgttaaagtatcaagatatacacattttaaaccatttgtacaaaacttctataaatttttctctctctttctctcttatgtacaaaaatatcttaatatatccccgaactggttaggatagatacaaatagattttttataataaaaaattcacaaaagattggaagcattctataatgaaaatggtagaaaagacagtgtgagggaagccatggggtttgggaatcgggccctggaggagaagcagagtttcaaagggctgagaatagcatagtttcactgtaaaccaatgtctacagcttattggggtgggggctactgagacgaaagacaccaactcgtttctagagggctaagaactgcactctaagaaagggcggggaggtgaagggacccgagcaagaactttcagctgtgcgtgttagaggtgatgggagttactataacgcgtgtgctgctcccttctgccaggagcccactgcttttgcacacaagctgcattttgcgcattgactcaggtcccagttgctcttcatatctccgtgaatgattggagtgcaaagatactgttctgagcgcttcccgttttctgaaagccatgtctctcaggcatgcctcgcttagttggcgatggggttggttgactgttttcgtttttttcttcttctcttttcttcttcttcttctttttttttcttttccttttctccccctcccaacgccactgacaagaaagcactaaagatgcaggttgtgcgatcaccctataacataaggaaaagaacaggagaggttaatttgaacgtgtaggctagtggtagagggagatggaggtctggggaaagagtctgtcaggtagacatctcttttaacatgtcccagtattcggttcaccagtatctctgcacctcactactacccttcactccttggagacctgggcaaggccattttcagaggccagtgctgaaactaacaaactaggacttgaaatcgaccaactttcacaaattctttaaataaaaatccccttatctccttggagacatccccacttccacagacactcagagggaggacgaaggcaagaatacccccctgcccaccccaaaatgcaacctacctgcttccaaagtccattcgcaccagggcctgaccaggccgagcccctcagaaccagttggtgaagtcgagaagctcctgctcctcggggctgagcgggtcgtaagagccctcgtccgacgagtaggatgagaccggcgagccggccatggagttcaagtcgttggagtagttgggggagatggtgggcgacaggacgcctgcctggaaggcggcgctcaccgcgtcatgctcgtccagcagctgctgcagcgcgcggatgtactcgaccgccgagcgcagtgtctccaccttactcatcttcttgttggccgcgccgttggggacgtgctcccgaagggtggcaaagcccaggttgaccaacttgacgcggttgcgctcgcgctcgttgcggcgcgccacggcggccggctgctgctgcggcaggctgtagccaaagccgctgaagttgagccggcgtttgcagcgcatcagttcgggcgaagacgagcgctgtcgcttgacttgcttgggcgctgacttgtgaccgccccctgagggctggccgtcggccgccggtctcagctgcggcgcctgctgctgctgctgctgctgctgctgctgctgctgcgcgctctgcgctgccgctgcggcggctgcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgaggtgcggggcccgcgagggggacacagagagaacttgggtgcaggaacagagagggaaagaaaaggaaatatgaagcgggagccctgacggaagttaaaaaatatatacaaaatccccgggagacttcttagagtgggagcaaaaaaagtgaaaatgctttttctcctccctgcacgccgcctcctcctccctcccctcctcccttcgcgggttggcttcgggagcctcgcgtggcgctcgcgtgtgaggctgccgctggcgccttcttgtttctaagaaaaaaaaaagcagaagcagcagcaaaagtcagtgctgaacgcgctctgccgcgtctcgcgttcctctcctactaaggctgcgctctcttgcgccgggtctcggtctctccagccgtggctcaggctgtttttattattttgttaactcccttcctttctgatttccttctttcactcgccctccctggccggatccctgtcggtgcgccttccacgttccctggccagaagctcgagag

SEQ ID NO: 2851 - DNA, 1156 bp, Artificial Sequence
  Synthetic oligonucleotide
tgattattttcattttaaaaaaaggaaaaagttttattacgaaactagtttgtataaaacagggttatacatatttttgtaagtttgtaataaaacagtaagaaaaaaaaggcagtaatagaaatctccaaaaggcaacctatcaaaaccaactggctgccactttgagtttggacagtagctgcataaactttgttcttcttgaacagtatttaataacatcattaatacattaacaacatttctataaagtaagacacattggtgctgaagtacaactggtggcctcttgatctcacctatgaggagagttctttacaaaaccacatagggaaaattgcagttgtaaggtgaactacacatctaaaatatgcagaggtaatagcattacatgttaaagtatcaagatatacacattttaaaccatttgtacaaaacttctataaatttttctctctctttctctcttatgtacaaaaatatcttaatatatccccgaactggttaggatagatacaaatagattttttataataaaaaattcacaaaagattggaagcattctataatgaaaatggtagaaaagacagtgtgagggaagccatggggtttgggaatcgggccctggaggagaagcagagtttcaaagggctgagaatagcatagtttcactgtaaaccaatgtctacagcttattggggtgggggctactgagacgaaagacaccaactcgtttctagagggctaagaactgcactctaagaaagggcggggaggtgaagggacccgagcaagaactttcagctgtgcgtgttagaggtgatgggagttactataacgcgtgtgctgctcccttctgccaggagcccactgcttttgcacacaagctgcattttgcgcattgactcaggtcccagttgctcttcatatctccgtgaatgattggagtgcaaagatactgttctgagcgcttcccgttttctgaaagccatgtctctcaggcatgcctcgcttagttggcgatggggttggttgactgttttcgtttttttcttcttctcttttcttcttcttcttctttttttttcttttccttttctccccctcccaacgccactgacaagaaagcactaaagatgcaggttgtgcgatcacc

SEQ ID NO: 2852 - DNA, 359 bp, Artificial Sequence
  Synthetic oligonucleotide
ctataacataaggaaaagaacaggagaggttaatttgaacgtgtaggctagtggtagagggagatggaggtctggggaaagagtctgtcaggtagacatctcttttaacatgtcccagtattcggttcaccagtatctctgcacctcactactacccttcactccttggagacctgggcaaggccattttcagaggccagtgctgaaactaacaaactaggacttgaaatcgaccaactttcacaaattctttaaataaaaatccccttatctccttggagacatccccacttccacagacactcagagggaggacgaaggcaagaatacccccctgcccaccccaaaatgcaacctac

SEQ ID NO: 2853 - DNA, 245 bp, Artificial Sequence
  Synthetic oligonucleotide
ctgcttccaaagtccattcgcaccagggcctgaccaggccgagcccctcagaaccagttggtgaagtcgagaagctcctgctcctcggggctgagcgggtcgtaagagccctcgtccgacgagtaggatgagaccggcgagccggccatggagttcaagtcgttggagtagttgggggagatggtgggcgacaggacgcctgcctggaaggcggcgctcaccgcgtcatgctcgtccagcagctg

SEQ ID NO: 2854 - DNA, 120 bp, Artificial Sequence
  Synthetic oligonucleotide
tgtcgcttgacttgcttgggcgctgacttgtgaccgccccctgagggctggccgtcggccgccggtctcagctgcggcgcctgctgctgctgctgctgctgctgctgctgctgctgcgcg

SEQ ID NO: 2855 - DNA, 178 bp, Artificial Sequence
  Synthetic oligonucleotide
ctgcggcggctgcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggac

SEQ ID NO: 2856 - DNA, 136 bp, Artificial Sequence
  Synthetic oligonucleotide
ttgggtgcaggaacagagagggaaagaaaaggaaatatgaagcgggagccctgacggaagttaaaaaatatatacaaaatccccgggagacttcttagagtgggagcaaaaaaagtgaaaatgctttttctcctcc

SEQ ID NO: 2857 - DNA, 160 bp, Artificial Sequence
  Synthetic oligonucleotide
ctgcacgccgcctcctcctccctcccctcctcccttcgcgggttggcttcgggagcctcgcgtggcgctcgcgtgtgaggctgccgctggcgccttcttgtttctaagaaaaaaaaaagcagaagcagcagcaaaagtcagtgctgaacgcgctctgccg

SEQ ID NO: 2858 - DNA, 118 bp, Artificial Sequence
  Synthetic oligonucleotide
ctgcagcgcgcggatgtactcgaccgccgagcgcagtgtctccaccttactcatcttcttgttggccgcgccgttggggacgtgctcccgaagggtggcaaagcccaggttgaccaac

SEQ ID NO: 2859 - DNA, 50 bp, Artificial Sequence
  Synthetic oligonucleotide
ttgacgcggttgcgctcgcgctcgttgcggcgcgccacggcggccggctg

SEQ ID NO: 2860 - DNA, 79 bp, Artificial Sequence
  Synthetic oligonucleotide
ctgctgcggcaggctgtagccaaagccgctgaagttgagccggcgtttgcagcgcatcagttcgggcgaagacgagcgc

SEQ ID NO: 2861 - DNA, 13 bp, Artificial Sequence
  Synthetic oligonucleotide
ctctgcgctgccg

SEQ ID NO: 2862 - DNA, 38 bp, Artificial Sequence
  Synthetic oligonucleotide
gcgaggtgcggggcccgcgagggggacacagagagaac

SEQ ID NO: 2863 - DNA, 98 bp, Artificial Sequence
  Synthetic oligonucleotide
cgtctcgcgttcctctcctactaaggctgcgctctcttgcgccgggtctcggtctctccagccgtggctcaggctgtttttattattttgttaactcc

SEQ ID NO: 2864 - DNA, 90 bp, Artificial Sequence
  Synthetic oligonucleotide
cttcctttctgatttccttctttcactcgccctccctggccggatccctgtcggtgcgccttccacgttccctggccagaagctcgagag

SEQ ID NO: 2865 - DNA, 2366 bp, Homo sapiens
cccctctcgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 2866 - DNA, 1859 bp, Homo sapiens
cccctctcgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagctt

SEQ ID NO: 2867 - DNA, 1802 bp, Homo sapiens
cccctctcgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacata

SEQ ID NO: 2868 - DNA, 2049 bp, Homo sapiens
cccctctcgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 2869 - DNA, 1887 bp, Homo sapiens
cccctctcgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccagggtgagccgcttcggactgcgaactaacgcggccttcttagctgctgcctgctctccctgcctcgcctgcgggagcctcccgagcgggagagggccgcaggagcgatttggggaggaaggtgggaggggactcaccaagagagcgccgaggtgggcccaggcctggtgagagagtgtgggggacgatggatggagggaggaagaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagctt

SEQ ID NO: 2870 - DNA, 1090 bp, Homo sapiens
tcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 2871 - DNA, 1264 bp, Homo sapiens
tcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 2872 - DNA, 526 bp, Homo sapiens
tcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacata

SEQ ID NO: 2873 - DNA, 757 bp, Homo sapiens
tcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagctt

SEQ ID NO: 2874 - DNA, 700 bp, Homo sapiens
tcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacata

SEQ ID NO: 2875 - DNA, 135 bp, Artificial Sequence
  Synthetic oligonucleotide
cccctctcgaacgccttcgcgcgatcgccctggaaacgcattctctgcgaccggcagccgccaatgggaagggagtgagtgccacgaacaggccaataaggagggagcagtgcggggtttaaatctgaggctagg

SEQ ID NO: 2876 - DNA, 136 bp, Artificial Sequence
  Synthetic oligonucleotide
ctggctcttctcggcgtgctgcggcggaacggctgttggtttctgctgggtgtaggtccttggctggtcgggcctccggtgttctgcttctccccgctgagctgctgcctggtgaagaggaagccatggcgctccg

SEQ ID NO: 2877 - DNA, 202 bp, Artificial Sequence
  Synthetic oligonucleotide
gtgagccgcttcggactgcgaactaacgcggccttcttagctgctgcctgctctccctgcctcgcctgcgggagcctcccgagcgggagagggccgcaggagcgatttggggaggaaggtgggaggggactcaccaagagagcgccgaggtgggcccaggcctggtgagagagtgtgggggacgatggatggagggaggaag

SEQ ID NO: 2878 - DNA, 171 bp, Artificial Sequence
  Synthetic oligonucleotide
gaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttg

SEQ ID NO: 2879 - DNA, 183 bp, Artificial Sequence
  Synthetic oligonucleotide
gttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgag

SEQ ID NO: 2880 - DNA, 143 bp, Artificial Sequence
  Synthetic oligonucleotide
gtgactttgcttttgtgactgacaacacttatactaagcaccaaatcagacagatggaaatgaagattctaagagctttaaactttggtctgggtcggcctctacctttgcacttccttcggagagcatctaagattggagag

SEQ ID NO: 2881 - DNA, 141 bp, Artificial Sequence
  Synthetic oligonucleotide
gttgatgtcgagcaacatactttggccaaatacctgatggaactaactatgttggactatgacatggtgcactttcctccttctcaaattgcagcaggagctttttgcttagcactgaaaattctggataatggtgaatgg

SEQ ID NO: 2882 - DNA, 241 bp, Artificial Sequence
  Synthetic oligonucleotide
tcaaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttag

SEQ ID NO: 2883 - DNA, 174 bp, Artificial Sequence
  Synthetic oligonucleotide
gtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccag

SEQ ID NO: 2884 - DNA, 738 bp, Artificial Sequence
  Synthetic oligonucleotide
actgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 2885 - DNA, 10 bp, Artificial Sequence
  Synthetic oligonucleotide
agtcaccagg

SEQ ID NO: 2886 - DNA, 80 bp, Artificial Sequence
  Synthetic oligonucleotide
aactcgaaaattaatgctgaaaataaggcgaagatcaacatggcaggcgcaaagcgcgttcctacggcccctgctgcaac

SEQ ID NO: 2887 - DNA, 91 bp, Artificial Sequence
  Synthetic oligonucleotide
ctccaagcccggactgaggccaagaacagctcttggggacattggtaacaaagtcagtgaacaactgcaggccaaaatgcctatgaagaag

SEQ ID NO: 2888 - DNA, 66 bp, Artificial Sequence
  Synthetic oligonucleotide
gaagagcaagcagtcagaccaaaatacctactgggtcgggaagtcactggaaacatgagagccatc

SEQ ID NO: 2889 - DNA, 12 bp, Artificial Sequence
  Synthetic oligonucleotide
ctaattgactgg

SEQ ID NO: 2890 - DNA, 81 bp, Artificial Sequence
  Synthetic oligonucleotide
ctagtacaggttcaaatgaaattcaggttgttgcaggagaccatgtacatgactgtctccattattgatcggttcatgcag

SEQ ID NO: 2891 - DNA, 94 bp, Artificial Sequence
  Synthetic oligonucleotide
aataattgtgtgcccaagaagatgctgcagctggttggtgtcactgccatgtttattgcaagcaaatatgaagaaatgtaccctccagaaattg

SEQ ID NO: 2892 - DNA, 52 bp, Artificial Sequence
  Synthetic oligonucleotide
acaccaactctacaacattacctgtcatatactgaagaatctcttcttccag

SEQ ID NO: 2893 - DNA, 59 bp, Artificial Sequence
  Synthetic oligonucleotide
ttatgcagcacctggctaagaatgtagtcatggtaaatcaaggacttacaaagcacatg

SEQ ID NO: 2894 - DNA, 3824 bp, Homo sapiens
ggcttgcgcgcgcgggagtcaggggtcacggcggcgtaggctgtggcgggaaacgctgtttgaagcggcttcagcactgactctgggctcccacaagcccctgcgcttcctctgtcccacccgggtctctcctcgcagatcatcactccctgtccctctctggctacttgcacaacccgaagccagagccgctaacgacgcttgcttcttcctgtctaagctgttgtaccaaggagcccccaaaacacagtggcccaagaaagatacaaattgatttctccacataacgctttggaagatagtagagacagggtttcaccatgttgataaggctggtctcaaacaactgacctcaagtgatccacccgcctcggcctctcaaagtgctgggattataggtgcgagccacggtgcccagctgggtacaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatatg

SEQ ID NO: 2895 - DNA, 4033 bp, Homo sapiens
ggcttgcgcgcgcgggagtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggtcaggcccacctggctgcctgctcccgcccagccccctcgctctcacttctgctttccgagatgggcgggcctgcgggaagggtggggcctcccgtgccctgtggggccctgagaaccgccccccatggcagcctgggtgtggcctcggccccctctggaggtcccccctctattctgacccctcccttgcttccctatggaaggggccccagtccctcccctgtgcatacagctccccagccgggggttcccttggattcataatcctccagctctacccccacccccagtgacccacatcttagccccatgacctctgacctcctgaccccttcctcatccttgcttccccttgtgaactctgacccttccgtggtgacctgagagccctacagactctgtggcccagagactccgtgacctccgaccccatcccagacccaggccccccccatgtcacagcccgcaggcaggcctaggccctaagccccaggccccatgaccaccccgtgtccaccccggtgccctttccctggctgcccgggtgtgactgccatgtggccgcaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatatg

SEQ ID NO: 2896 - DNA, 4114 bp, Homo sapiens
ggcttgcgcgcgcgggagtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggtcaggcccacctggctgcctgctcccgcccagccccctcgctctcacttctgctttccgagatgggcgggcctgcgggaagggtggggcctcccgtgccctgtggggccctgagaaccgccccccatggcagcctgggtgtggcctcggccccctctggaggtcccccctctattctgacccctcccttgcttccctatggaaggggccccagtccctcccctgtgcatacagctccccagccgggggttcccttggattcataatcctccagctctacccccacccccagtgacccacatcttagccccatgacctctgacctcctgaccccttcctcatccttgcttccccttgtgaactctgacccttccgtggtgacctgagagccctacagactctgtggcccagagactccgtgacctccgaccccatcccagacccaggccccccccatgtcacagcccgcaggcaggcctaggccctaagccccaggccccatgaccaccccgtgtccaccccggtgccctttccctggctgcccgggtgtgactgccatgtggccgcaggacccgctgttcgtgctggagcacagcctgcccattgacacgcagtactacctggagcagcagctggccaagcccctcctgcgcatcttcgagcccatcctgggcgagggccgtgccgaggctgtgctactgcgtacgggggcaccaggggactgggggcaccctgggggggcagaggagatcaccggcccaccacctgcctcctctcctgcagggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatatg

SEQ ID NO: 2897 - DNA, 617 bp, Homo sapiens
ccctcaacctgctctgccgtcaccccagatcctagacacccaccccatcggctggcactgccacccagtgggcccagggcccctgggtgggtggcccctgtctccaccccccacagagggtcctcggcccccaccccgggagttccccaggggagttttcccagcacacttgctccgttgttctccagcctctggggactttcagaagctgggattggcagtgggcagggatggggtggcccagttcctggctgggccccagcacttgggctgacccgcctccccacaggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatatg

SEQ ID NO: 2898 - DNA, 145 bp, Artificial Sequence
  Synthetic oligonucleotide
cttcagcactgactctgggctcccacaagcccctgcgcttcctctgtcccacccgggtctctcctcgcagatcatcactccctgtccctctctggctacttgcacaacccgaagccagagccgctaacgacgcttgcttcttcct

SEQ ID NO: 2899 - DNA, 126 bp, Artificial Sequence
  Synthetic oligonucleotide
tagagacagggtttcaccatgttgataaggctggtctcaaacaactgacctcaagtgatccacccgcctcggcctctcaaagtgctgggattataggtgcgagccacggtgcccagctgggtacag

SEQ ID NO: 2900 - DNA, 157 bp, Artificial Sequence
  Synthetic oligonucleotide
gatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggag

SEQ ID NO: 2901 - DNA, 147 bp, Artificial Sequence
  Synthetic oligonucleotide
gcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctg

SEQ ID NO: 2902 - DNA, 126 bp, Artificial Sequence
  Synthetic oligonucleotide
gtttcgggcccgagcacatgggtgacctgcaacgggagctgaacttggccatcagccgggacagtcgcggggggagggagctgactgggccggccgtgctggctgtggaactgtgctcccgagaga

SEQ ID NO: 2903 - DNA, 169 bp, Artificial Sequence
  Synthetic oligonucleotide
gcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccg

SEQ ID NO: 2904 - DNA, 130 bp, Artificial Sequence
  Synthetic oligonucleotide
gctacgcagtgccagctggaggcggacgtgctgtggtctgacgtggtcagtcacccaccggaagggccatggcagcgcattgcgcccttgcgcgtgctcagcttcgatatcgagtgcgccggccgcaaag

SEQ ID NO: 2905 - DNA, 129 bp, Artificial Sequence
  Synthetic oligonucleotide
atctgctcgctgggcctgcgctggggggagccggagcccttcctacgcctggcgctcaccctgcggccctgtgcccccatcctgggtgccaaggtgcagagctacgagaaggaggaggacctgctgcag

SEQ ID NO: 2906 - DNA, 192 bp, Artificial Sequence
  Synthetic oligonucleotide
aatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcag

SEQ ID NO: 2907 - DNA, 176 bp, Artificial Sequence
  Synthetic oligonucleotide
gtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccg

SEQ ID NO: 2908 - DNA, 569 bp, Artificial Sequence
  Synthetic oligonucleotide
gtcaggcccacctggctgcctgctcccgcccagccccctcgctctcacttctgctttccgagatgggcgggcctgcgggaagggtggggcctcccgtgccctgtggggccctgagaaccgccccccatggcagcctgggtgtggcctcggccccctctggaggtcccccctctattctgacccctcccttgcttccctatggaaggggccccagtccctcccctgtgcatacagctccccagccgggggttcccttggattcataatcctccagctctacccccacccccagtgacccacatcttagccccatgacctctgacctcctgaccccttcctcatccttgcttccccttgtgaactctgacccttccgtggtgacctgagagccctacagactctgtggcccagagactccgtgacctccgaccccatcccagacccaggccccccccatgtcacagcccgcaggcaggcctaggccctaagccccaggccccatgaccaccccgtgtccaccccggtgccctttccctggctgcccgggtgtgactgccatgtggccgcag

SEQ ID NO: 2909 - DNA, 289 bp, Artificial Sequence
  Synthetic oligonucleotide
ccctcaacctgctctgccgtcaccccagatcctagacacccaccccatcggctggcactgccacccagtgggcccagggcccctgggtgggtggcccctgtctccaccccccacagagggtcctcggcccccaccccgggagttccccaggggagttttcccagcacacttgctccgttgttctccagcctctggggactttcagaagctgggattggcagtgggcagggatggggtggcccagttcctggctgggccccagcacttgggctgacccgcctccccacag

SEQ ID NO: 2910 - DNA, 139 bp, Artificial Sequence
  Synthetic oligonucleotide
ccgggactgccccatcttctacatgcgcaagaaggtgcggaaggacctggaagaccaggagcagctcctgcggcgcttcggaccccctggacctgaggcctggtgaccttgcaagcatcccatggggcgggggcgggac

SEQ ID NO: 2911 - DNA, 68 bp, Artificial Sequence
  Synthetic oligonucleotide
ggcttgcgcgcgcgggagtcaggggtcacggcggcgtaggctgtggcgggaaacgctgtttgaagcgg

SEQ ID NO: 2912 - DNA, 89 bp, Artificial Sequence
  Synthetic oligonucleotide
gtctaagctgttgtaccaaggagcccccaaaacacagtggcccaagaaagatacaaattgatttctccacataacgctttggaagatag

SEQ ID NO: 2913 - DNA, 12 bp, Artificial Sequence
  Synthetic oligonucleotide
caggaggaggag

SEQ ID NO: 2914 - DNA, 34 bp, Artificial Sequence
  Synthetic oligonucleotide
gagctgcagtcagtcctggagggggttgcagacg

SEQ ID NO: 2915 - DNA, 114 bp, Artificial Sequence
  Synthetic oligonucleotide
ggcaggtcccaccatcagccatagatcctcgctggcttcggcccacaccaccagcgctggacccccagacagagcccctcatcttccaacagttggagattgaccattatgtgg

SEQ ID NO: 2916 - DNA, 82 bp, Artificial Sequence
  Synthetic oligonucleotide
gttcatggtggacacggacatcgtcggctgcaactggctggagctcccagctgggaaatacgccctgaggctgaaggagaag

SEQ ID NO: 2917 - DNA, 27 bp, Artificial Sequence
  Synthetic oligonucleotide
gcatcttccctgagcctgagcgggacc

SEQ ID NO: 2918 - DNA, 11 bp, Artificial Sequence
  Synthetic oligonucleotide
ctgtcatccag

SEQ ID NO: 2919 - DNA, 105 bp, Artificial Sequence
  Synthetic oligonucleotide
gcctggtccaccttcatccgtatcatggaccccgacgtgatcaccggttacaacatccagaacttcgaccttccgtacctcatctctcgggcccagaccctcaag

SEQ ID NO: 2920 - DNA, 68 bp, Artificial Sequence
  Synthetic oligonucleotide
gtacaaacattccctttcctgggccgtgtggccggcctttgctccaacatccgggactcttcattcca

SEQ ID NO: 2921 - DNA, 73 bp, Artificial Sequence
  Synthetic oligonucleotide
gtccaagcagacgggccggcgggacaccaaggttgtcagcatggtgggccgcgtgcagatggacatgctgcag

SEQ ID NO: 2922 - DNA, 111 bp, Artificial Sequence
  Synthetic oligonucleotide
gtgctgctgcgggagtacaagctccgctcctacacgctcaatgccgtgagcttccacttcctgggcgagcagaaggaggacgtgcagcacagcatcatcaccgacctgcag

SEQ ID NO: 2923 - DNA, 89 bp, Artificial Sequence
  Synthetic oligonucleotide
gccatgcacgaggggctgctgatgcccgtggtgaagtcagagggcggcgaggactacacgggagccactgtcatcgagcccctcaaagg

SEQ ID NO: 2924 - DNA, 117 bp, Artificial Sequence
  Synthetic oligonucleotide
gtactacgacgtccccatcgccaccctggacttctcctcgctgtacccgtccatcatgatggcccacaacctgtgttacaccacgctccttcggcccgggactgcacagaaactggg

SEQ ID NO: 2925 - DNA, 114 bp, Artificial Sequence
  Synthetic oligonucleotide
cctgactgaggatcagttcatcaggacccccaccggggacgagtttgtgaagacctcagtgcggaaggggctgctgccccagatcctggagaacctgctcagtgcccggaagag

SEQ ID NO: 2926 - DNA, 76 bp, Artificial Sequence
  Synthetic oligonucleotide
ggccaaggccgagctggccaaggagacagaccccctccggcgccaggtcctggatggacggcagctggcgctgaag

SEQ ID NO: 2927 - DNA, 72 bp, Artificial Sequence
  Synthetic oligonucleotide
gtgagcgccaactccgtatacggcttcactggcgcccaggtgggcaagttgccgtgcctggagatctcacag

SEQ ID NO: 2928 - DNA, 96 bp, Artificial Sequence
  Synthetic oligonucleotide
agcgtcacggggttcggacgtcagatgatcgagaaaaccaagcagctggtggagtctaagtacacagtggagaatggctacagcaccagtgccaag

SEQ ID NO: 2929 - DNA, 100 bp, Artificial Sequence
  Synthetic oligonucleotide
gtggtgtatggtgacactgactccgtcatgtgccgattcggcgtgtcctcggtggctgaggcgatggccctggggcgggaggccgcggactgggtgtcag

SEQ ID NO: 2930 - DNA, 38 bp, Artificial Sequence
  Synthetic oligonucleotide
gtcacttcccgtcgcccatccggctggagtttgagaag

SEQ ID NO: 2931 - DNA, 99 bp, Artificial Sequence
  Synthetic oligonucleotide
agaccctgagggcgcggtggctcacgcacaggacgtcatctcggacctgctgtgcaaccgcatcgatatctcccagctggtcatcaccaaggagctgac

SEQ ID NO: 2932 - DNA, 54 bp, Artificial Sequence
  Synthetic oligonucleotide
ccgcgcggcctccgactatgccggcaagcaggcccacgtggagctggccgagag

SEQ ID NO: 2933 - DNA, 103 bp, Artificial Sequence
  Synthetic oligonucleotide
gatgaggaagcgggaccccgggagtgcgcccagcctgggcgaccgcgtcccctacgtgatcatcagtgccgccaagggtgtggccgcctacatgaagtcggag

SEQ ID NO: 2934 - DNA, 45 bp, Artificial Sequence
  Synthetic oligonucleotide
gacccgctgttcgtgctggagcacagcctgcccattgacacgcag

SEQ ID NO: 2935 - DNA, 88 bp, Artificial Sequence
  Synthetic oligonucleotide
tactacctggagcagcagctggccaagcccctcctgcgcatcttcgagcccatcctgggcgagggccgtgccgaggctgtgctactgc

SEQ ID NO: 2936 - DNA, 81 bp, Artificial Sequence
  Synthetic oligonucleotide
gtacgggggcaccaggggactgggggcaccctgggggggcagaggagatcaccggcccaccacctgcctcctctcctgcag

SEQ ID NO: 2937 - DNA, 114 bp, Artificial Sequence
  Synthetic oligonucleotide
ggggggaccacacgcgctgcaagacggtgctcacgggcaaggtgggcggcctcctggccttcgccaaacgccgcaactgctgcattggctgccgcacagtgctcagccaccagg

SEQ ID NO: 2938 - DNA, 23 bp, Artificial Sequence
  Synthetic oligonucleotide
gagccgtgtgtgagttctgccag

SEQ ID NO: 2939 - DNA, 30 bp, Artificial Sequence
  Synthetic oligonucleotide
ccccgggagtctgagctgtatcagaaggag

SEQ ID NO: 2940 - DNA, 98 bp, Artificial Sequence
  Synthetic oligonucleotide
gtatcccatctgaatgccctggaggagcgcttctcgcgcctctggacgcagtgccagcgctgccagggcagcctgcacgaggacgtcatctgcaccag

SEQ ID NO: 2941 - DNA, 38 bp, Artificial Sequence
  Synthetic oligonucleotide
cagggagaattaataaagttctggacttttgctatatg

SEQ ID NO: 2942 - DNA, 3835 bp, Homo sapiens
gagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcaggtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttgcttgccgcctgtccccaaggaaggaccgtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgttttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 2943 - DNA, 5038 bp, Homo sapiens
gagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattgggtatgtgtttcctgggttaggggaaggactctgccctattgagggctgtgaggttttctgaagacttggcctttagagatacaaggatcctccagccagagtcaggcccactgtgtgaaactggagttcgttatttatgaggactgagtatgggtcttcaaatagggtctcggtctatccacccaggctggagtgcagtagtgtaatcacagttcactgcagctttggtgtctcaggctcaagtgatcctcccacctcagcctcctgagtagctgggactataggcacgtgccaccacactcggttaatgtttatagagacagggttttgccatgttgcccaggctggagttcttcttgataatgggcctgttcctcttcagtctgttgggctgaagctttaccttggttagctaaagccaagaaaggcaagagttagggctgggacatgtgtggccaaaggcagtgttactctcctggcatcaaatgttgggccagtcccgtcccccacctctactcagggttggaaaacccatgatcttgggaatccctgccatgtgcagttagaggaggtaagaagtaggcacaaggcctttaggggaacagtaacaatgctggggccgactcagcctctccctcccattccccaggtccccagcaacttgagggcatcaaagaagcctagacgaggtaaaggccagttctcaagccaagaatccttccaggaagaaattcttattacttgccagctggaactgccatccttggcagcttcgtgggacaaaggatagagtgggcagaagcctggcctggtgtctaaagttcccatccgggccaaatctgttcccattgtgtaggaggcctgaggttctaggttcttttgggcccagtcccctgagggaccactcccactgctggggcaatccctgtgggcacgtgagcatctgcctactctgtgagaggccttgacctggccacagcagacaccatgggaggaatgtggattgttggttggggagacggacataagacacaaatcacaacatggtattgtgttatgcaatatgggcaagaatggagctctttgggagcacagtgaagggcacccaacccacctgggggtttaggaaaggtggaaaaattgagttaggaagcataagcaggagtcaacctgattgacttggtttgtgggtgaggcagggaggacactggccaagtctactcagcagtgtggatgagacggattactgagtggaagcactacctccaaccccaatatctaagtcttttgtgaattggtcagactccacgattcactgggtggatgggtacaatagatttgatgtactggaattcccaacccttggctcctctcccaacttctgacccctaaaatcagaggaacaatgaggtatccccttgacctggtatggttatcaggccctgagtgaagtgaaagtctaatctgcttctacctcttctccttcctctaagggtctcccaggtggttctcaacccacactttctggagccagagggattccaataaacccctgacattggcccaattctttcttgtgcagtctagccttccctgaccaacactgttgacctctgccctttcccatggcaccagactcctcagccttgaggagggggaacaggacaccttctctagtaaggggcacatccctgtgagcctcctggcaaaattgccaggtcctgatgggacaatatttgtattggcgcacctcttcccagccccacctacccctccccatctcactctaggcccaggaacacaagtccatacctgttacacattcttaagagtttctcactccagactcccaagaaataaaacatggcaagaataaaatatgaaagaaggag

SEQ ID NO: 2944 - DNA, 363 bp, Artificial Sequence
  Synthetic oligonucleotide
ctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccc

SEQ ID NO: 2945 - DNA, 688 bp, Artificial Sequence
  Synthetic oligonucleotide
gtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttgcttgccgcctgtccccaaggaaggaccgtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgttttccagtaaccaggcctcccgcttctctctctcctgccag

SEQ ID NO: 2946 - DNA, 176 bp, Artificial Sequence
  Synthetic oligonucleotide
ccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccg

SEQ ID NO: 2947 - DNA, 205 bp, Artificial Sequence
  Synthetic oligonucleotide
cggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcc

SEQ ID NO: 2948 - DNA, 462 bp, Artificial Sequence
  Synthetic oligonucleotide
tcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtcc

SEQ ID NO: 2949 - DNA, 1053 bp, Artificial Sequence
  Synthetic oligonucleotide
tggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagc

SEQ ID NO: 2950 - DNA, 2088 bp, Artificial Sequence
  Synthetic oligonucleotide
tgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattgggtatgtgtttcctgggttaggggaaggactctgccctattgagggctgtgaggttttctgaagacttggcctttagagatacaaggatcctccagccagagtcaggcccactgtgtgaaactggagttcgttatttatgaggactgagtatgggtcttcaaatagggtctcggtctatccacccaggctggagtgcagtagtgtaatcacagttcactgcagctttggtgtctcaggctcaagtgatcctcccacctcagcctcctgagtagctgggactataggcacgtgccaccacactcggttaatgtttatagagacagggttttgccatgttgcccaggctggagttcttcttgataatgggcctgttcctcttcagtctgttgggctgaagctttaccttggttagctaaagccaagaaaggcaagagttagggctgggacatgtgtggccaaaggcagtgttactctcctggcatcaaatgttgggccagtcccgtcccccacctctactcagggttggaaaacccatgatcttgggaatccctgccatgtgcagttagaggaggtaagaagtaggcacaaggcctttaggggaacagtaacaatgctggggccgactcagcctctccctcccattccccaggtccccagcaacttgagggcatcaaagaagcctagacgaggtaaaggccagttctcaagccaagaatccttccaggaagaaattcttattacttgccagctggaactgccatccttggcagcttcgtgggacaaaggatagagtgggcagaagcctggcctggtgtctaaagttcccatccgggccaaatctgttcccattgtgtaggaggcctgaggttctaggttcttttgggcccagtcccctgagggaccactcccactgctggggcaatccctgtgggcacgtgagcatctgcctactctgtgagaggccttgacctggccacagcagacaccatgggaggaatgtggattgttggttggggagacggacataagacacaaatcacaacatggtattgtgttatgcaatatgggcaagaatggagctctttgggagcacagtgaagggcacccaacccacctgggggtttaggaaaggtggaaaaattgagttaggaagcataagcaggagtcaacctgattgacttggtttgtgggtgaggcagggaggacactggccaagtctactcagcagtgtggatgagacggattactgagtggaagcactacctccaaccccaatatctaagtcttttgtgaattggtcagactccacgattcactgggtggatgggtacaatagatttgatgtactggaattcccaacccttggctcctctcccaacttctgacccctaaaatcagaggaacaatgaggtatccccttgacctggtatggttatcaggccctgagtgaagtgaaagtctaatctgcttctacctcttctccttcctctaagggtctcccaggtggttctcaacccacactttctggagccagagggattccaataaacccctgacattggcccaattctttcttgtgcagtctagccttccctgaccaacactgttgacctctgccctttcccatggcaccagactcctcagccttgaggagggggaacaggacaccttctctagtaaggggcacatccctgtgagcctcctggcaaaattgccaggtcctgatgggacaatatttgtattggcgcacctcttcccagccccacctacccctccccatctcactctaggcccaggaacacaagtccatacctgttacacattcttaagagtttctcactccagactcccaagaaataaaacatggcaagaataaaatatgaaagaaggag

SEQ ID NO: 2951 - DNA, 81 bp, Artificial Sequence
  Synthetic oligonucleotide
gagatcccagcgcgcagaacttggggagccgccgccgccatccgccgccgcagccagcttccgccgccgcaggaccggccc

SEQ ID NO: 2952 - DNA, 25 bp, Artificial Sequence
  Synthetic oligonucleotide
cagagggcagcggcagcaacagcag

SEQ ID NO: 2953 - DNA, 48 bp, Artificial Sequence
  Synthetic oligonucleotide
cagcagcagcagcgggggcggtggaggcggcgggggcggcagcaacag

SEQ ID NO: 2954 - DNA, 71 bp, Artificial Sequence
  Synthetic oligonucleotide
cagcagcagcagcagcaccttcaaccctcaggcggacacgggcgagcagccctacgagcacctgaccgcag

SEQ ID NO: 2955 - DNA, 61 bp, Artificial Sequence
  Synthetic oligonucleotide
agtcttttcctgacatctctctgaacaacgagaaggtgctggtggagaccagttaccccag

SEQ ID NO: 2956 - DNA, 69 bp, Artificial Sequence
  Synthetic oligonucleotide
cctccgcctcccagagcccacccctgagctgcgcagtgccatccaacgacagcagtcccatttactcag

SEQ ID NO: 2957 - DNA, 31 bp, Artificial Sequence
  Synthetic oligonucleotide
cttccagggcctggagagccgcacccagcag

SEQ ID NO: 2958 - DNA, 45 bp, Artificial Sequence
  Synthetic oligonucleotide
ccttcgctaacccctctgtctactattaaggcctttgccactcag

SEQ ID NO: 2959 - DNA, 107 bp, Artificial Sequence
  Synthetic oligonucleotide
ccggttactacctcttatccatccccggccaccacctcatacccatcccctgtgcccacctccttctcctctcccggctcctcgacctacccatcccctgtgcacag

SEQ ID NO: 2960 - DNA, 21 bp, Artificial Sequence
  Synthetic oligonucleotide
aaaataaggaagagggctgag

SEQ ID NO: 2961 - DNA, 77 bp, Artificial Sequence
  Synthetic oligonucleotide
ctgagcttcggttctccagaatgtaagaaaacaaaatctaaaacaaaatctgaactctcaaaagtctatttttttaa

SEQ ID NO: 2962 - DNA, 55 bp, Artificial Sequence
  Synthetic oligonucleotide
ctgaaaatgtaaatttataaatatattcaggagttggaatgttgtagttacctac

SEQ ID NO: 2963 - DNA, 1798 bp, Homo sapiens
aagaaagtaaatgtgttcgttcttcacttttaagggactgctctcactgtctcatcaaatcagtacagagaataggaaggtcttttttctgaatatttgaaatgctccaaaggaagtgccaaatatagaaaaagcaacataaaatcaagaatcactcataaccttctgattaccctggcactttctatgaaggagtagagtaaagttggcccccacctggaatatagctcctccctacccccaacaatggaccctgcccattgcctcccagttccttgatcttcctaggttccacaactctctttttccttttagttttattccctccagccaaacctctcttattcaatattttgagccaatgggggagttatgtagatttttttccctacacattagctggccccttttatgaccaatgactcataaggcaagatgtgtggtggcatcttcggacaggcagcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtattttaaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcagctgctcctctagtaataagttcctggggataatacattaaccaacattggttgaaacatacctgagtaatcatatcaggatgcatgttaagctgataaaacaataagatcccaaaatgcagtagctcaaaaaaaagtagaagttaatttatctcctgggggacagctctggttctcaaattttacaggctcagaatcacctgcagggcttgtgaaagtacagattgctgcgctccgcccccagagtttctgatttagtaggtgttaggctgaaccaagaatttgcctttctaacaagctcccaagtgatgctgatgacttgtaggaatggatttacttctaggattagacttcagctcactctgtttgctgaactctttctaatatttcttaagttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 2964 - DNA, 1418 bp, Artificial Sequence
  Synthetic oligonucleotide
aagaaagtaaatgtgttcgttcttcacttttaagggactgctctcactgtctcatcaaatcagtacagagaataggaaggtcttttttctgaatatttgaaatgctccaaaggaagtgccaaatatagaaaaagcaacataaaatcaagaatcactcataaccttctgattaccctggcactttctatgaaggagtagagtaaagttggcccccacctggaatatagctcctccctacccccaacaatggaccctgcccattgcctcccagttccttgatcttcctaggttccacaactctctttttccttttagttttattccctccagccaaacctctcttattcaatattttgagccaatgggggagttatgtagatttttttccctacacattagctggccccttttatgaccaatgactcataaggcaagatgtgtggtggcatcttcggacaggcagcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtattttaaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcagctgctcctctagtaataagttcctggggataatacattaaccaacattggttgaaacatacctgagtaatcatatcaggatgcatgttaagctgataaaacaataagatcccaaaatgcagtagctcaaaaaaaagtagaagttaatttatctcctgggggacagctctggttctcaaattttacaggctcagaatcacctgcagggcttgtgaaagtacagattgctgcgctccgcccccagagtttctgatttagtaggtgttaggctgaaccaagaatttgcctttctaacaagctcccaagtgatgctgatgacttgtaggaatggatttacttctaggattagacttcagctcactctgtttgctgaactctttctaatatttcttaag

SEQ ID NO: 2965 - DNA, 359 bp, Artificial Sequence
  Synthetic oligonucleotide
gttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 2966 - DNA, 7 bp, Artificial Sequence
  Synthetic oligonucleotide
ttggtag

SEQ ID NO: 2967 - DNA, 14 bp, Artificial Sequence
  Synthetic oligonucleotide
actctctgctccag

SEQ ID NO: 2968 - DNA, 1442 bp, Homo sapiens
ccgcgggcgacaatggcatgcggggccccgcccgcgccccgctccgacaccgctggggacagggccgggtgatcccgcgctccccgatgcagccggggccgagcaacgcgccgggaggggccgctgggggcgaacggggcccgggacccccggggctgggcggagtctcggggctcactctcccgcccagggggccgggagccggggctggacggagctggggctgtggccgcgcgggaagtcgggaaggaaattcccccagtggcgcagggtccggcggcgccgaggggtgggcgagcctcggtctcgagcctcttggcttcctccgcccgtccccactccggtcccggtttgggccctgctcggtctccgagtttgatccgacaccggctcggcctccgggggtcccaccctcaggtgtgcggcctggagcacggagggctgcagaaagccttgggagcgacagagccgggggaaggtcggcggccgggtcggcaggcgggagggcggagtcagcggacggcgaaggggcgcacgggtggccccgcagagcagggccggtgatggcgcgggccgggccggaccacgaggagcagaacgtgcgcgtgacgcgagcgggctggtgacgtcaccaggcacccggggcgatgacgcaagcctgctgggatgacgtcatgtggcccgtgtcgccacgtgcttccagagatggggatctccctatgttgcccaggctggtctcgaactcctggcccgagacgatgctcctgcctcggcctcccaacgtgctgggactacaggcgaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 2969 - DNA, 787 bp, Homo sapiens
cggcctcacgcgtccgtgcagcggaggcttcctgagccccctggagagcctggcctgggcccgggtgtggagaccctcccgggctttcaatccgggcaggaggcagatggcagactcagcagtcacgtaagagaaccgaattaggaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 2970 - DNA, 769 bp, Homo sapiens
cggcctcacgcgtccgtgcagcggaggcttcctgagccccctggagagcctggcctgggcccgggtgtggagaccctcccgggctttcaatccgggcaggaggcagatggcagactcagcagtcacgaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 2971 - DNA, 1121 bp, Homo sapiens
ccgcgggcgacaatggcatgcggggccccgcccgcgccccgctccgacaccgctggggacagggccgggtgatcccgcgctccccgatgcagccggggccgagcaacgcgccgggaggggccgctgggggcgaacggggcccgggacccccggggctgggcggagtctcggggctcactctcccgcccagggggccgggagccggggctggacggagctggggctgtggccgcgcgggaagtcgggaaggaaattcccccagtggcgcagggtccggcggcgccgaggggtgggcgagcctcggtctcgagcctcttggcttcctccgcccgtccccactccggtcccggtttgggccctgctcggtctccgagtttgatccgacaccggctcggcctccgggggtcccaccctcaggtgtgcggcctggagcacggagggctgcagaaagccttgggagcgacagagccgggggaaggaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 2972 - DNA, 1119 bp, Homo sapiens
cgcaggctcggcggcacgccccctgacgtgtgtgcctcaggcttaataatagggccggtgctgcctgcggaagccggcggctgagaggcagcgaactcatctttgccagtacaggagctcgtgccgtggcccacagcccacagcccacagccatggtaaggcagatgtcacaggtggggggaggtgggctctgtgccagccaattttcgtctccctcccccagccaaggtctcccaggggtgcagggagagcggagctgctcagagcttggccaggttctaagtgtgctcctgaaagcaggtcacccctgagatcctcagggtggggcacagaggggcaccctagcaggtaaagggaggccacgggatggcggtgggcagctggccttctagtaacgagccctcagtgccttctgtgcctggggtccctgccgacgggatgtagaggacagacaggagggagcactgtccctgggtacaggagctcgccctgcagccagtgccttgtgtgtggtgggcctggggctggcgccgcagtctctgaacctgtgtgacgcctgcagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 2973 - DNA, 794 bp, Homo sapiens
ccgcgggcgacaatggcatgcggggccccgcccgcgccccgctccgacaccgctggggacagggccgggtgatcccgcgctccccgatgcagccggggccgagcaacgcgccgggaggggccgctgggggcgaacggggcccgggacccccggggctgggcggagtctcggggctcactctcccgcccagggggccgggagccggggctggacggagctggggctgtggccgcgcgggaagtcgggaaggaaattcccccagtggcgcagggtccggcggcgccgaggggtgggcgagcctcggtctcgagcctcttggcttcctccgcccgtccccactccggtcccggtttgggccctgctcggtctccgagtttgatccgacaccggctcggcctccgggggtcccaccctcaggtgtgcggcctggagcacggagggctgcagaaagccttgggagcgacagagccgggggaaggtcggcggccgggtcggcaggcgggagggcggagtcagcggacggcgaaggggcgcacgggtggccccgcagagcagggccggtgatggcgcgggccgggccggaccacgaggagcagaacgtgcgcgtgacgcgagcgggctggtgacgtcaccaggcacccggggcgatgacgcaagcctgctgggatgacgtcatgtggcccgtgtcgccacgtgcttccaggtgacccgctggcgaactcagcagcagcaaagtggggctcacagaaaaatgaggggccactgttaatataactgcaaaggggcaggttgcg

SEQ ID NO: 2974 - DNA, 478 bp, Artificial Sequence
  Synthetic oligonucleotide
ccgcgggcgacaatggcatgcggggccccgcccgcgccccgctccgacaccgctggggacagggccgggtgatcccgcgctccccgatgcagccggggccgagcaacgcgccgggaggggccgctgggggcgaacggggcccgggacccccggggctgggcggagtctcggggctcactctcccgcccagggggccgggagccggggctggacggagctggggctgtggccgcgcgggaagtcgggaaggaaattcccccagtggcgcagggtccggcggcgccgaggggtgggcgagcctcggtctcgagcctcttggcttcctccgcccgtccccactccggtcccggtttgggccctgctcggtctccgagtttgatccgacaccggctcggcctccgggggtcccaccctcaggtgtgcggcctggagcacggagggctgcagaaagccttgggagcgacagagccgggggaag

SEQ ID NO: 2975 - DNA, 225 bp, Artificial Sequence
  Synthetic oligonucleotide
gtcggcggccgggtcggcaggcgggagggcggagtcagcggacggcgaaggggcgcacgggtggccccgcagagcagggccggtgatggcgcgggccgggccggaccacgaggagcagaacgtgcgcgtgacgcgagcgggctggtgacgtcaccaggcacccggggcgatgacgcaagcctgctgggatgacgtcatgtggcccgtgtcgccacgtgcttccag

SEQ ID NO: 2976 - DNA, 126 bp, Artificial Sequence
  Synthetic oligonucleotide
cggcctcacgcgtccgtgcagcggaggcttcctgagccccctggagagcctggcctgggcccgggtgtggagaccctcccgggctttcaatccgggcaggaggcagatggcagactcagcagtcac

SEQ ID NO: 2977 - DNA, 155 bp, Artificial Sequence
  Synthetic oligonucleotide
cgcaggctcggcggcacgccccctgacgtgtgtgcctcaggcttaataatagggccggtgctgcctgcggaagccggcggctgagaggcagcgaactcatctttgccagtacaggagctcgtgccgtggcccacagcccacagcccacagccatg

SEQ ID NO: 2978 - DNA, 407 bp, Artificial Sequence
  Synthetic oligonucleotide
gtaaggcagatgtcacaggtggggggaggtgggctctgtgccagccaattttcgtctccctcccccagccaaggtctcccaggggtgcagggagagcggagctgctcagagcttggccaggttctaagtgtgctcctgaaagcaggtcacccctgagatcctcagggtggggcacagaggggcaccctagcaggtaaagggaggccacgggatggcggtgggcagctggccttctagtaacgagccctcagtgccttctgtgcctggggtccctgccgacgggatgtagaggacagacaggagggagcactgtccctgggtacaggagctcgccctgcagccagtgccttgtgtgtggtgggcctggggctggcgccgcagtctctgaacctgtgtgacgcctgcag

SEQ ID NO: 2979 - DNA, 557 bp, Artificial Sequence
  Synthetic oligonucleotide
ggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 2980 - DNA, 91 bp, Artificial Sequence
  Synthetic oligonucleotide
gtgacccgctggcgaactcagcagcagcaaagtggggctcacagaaaaatgaggggccactgttaatataactgcaaaggggcaggttgcg

SEQ ID NO: 2981 - DNA, 18 bp, Artificial Sequence
  Synthetic oligonucleotide
gtaagagaaccgaattag

SEQ ID NO: 2982 - DNA, 96 bp, Artificial Sequence
  Synthetic oligonucleotide
agatggggatctccctatgttgcccaggctggtctcgaactcctggcccgagacgatgctcctgcctcggcctcccaacgtgctgggactacaggc

SEQ ID NO: 2983 - DNA, 86 bp, Artificial Sequence
  Synthetic oligonucleotide
gaatcgcttaattctgaaagtctggtgagaagacacggcgagaatcggggtccagcacagatgatggcgacagcggagaagggaag

SEQ ID NO: 2984 - DNA, 3421 bp, Homo sapiens
gggacaggaagcctcgtaaggtctcaccaggtggcaagcacactggattagaagatgcaggaaagcaccttccagtctgaagatcatttaaagactcagtcatgtaagggcatcccttggcttcttaatctacgtactccagacccagggcttggacctttgctggtacgggttaaagtgaggccgacagtgaaggtccacgtggagagagacattgggaagttgtcaaaaaggcgtttagaatcaggtttgactcattaatttcctgagactctgaaggagttcagcctctacacctcagtttcccctgggaaaactgggagtaacattttcctcatgatggttgaaaggattcatgcttacgtggatgtggcacactcagtaagtgtctaatctctggcgaaatacccagaagaaaagcctgtgactgaatatattatttttgagcacaattacttagtccacaattgagcataagggccttgatccattgtcttcctactgtccccaaacgcctacagctaatcgtgaggaatcaggctctctgaataaccacgtgtctcctggaaaccagttccccaagggatctggtttaatattgacaaagtaactgataatgtaactttccaactctctgcttggagcagatgctttttggtcatctgagattgggacctgtagacaaaggcaggcaaggaggggctgagttaagcctttggtgttccgctgtaagtagaatactacctaccagaggaacattccagcccttgacttgctctgcctgctggtgagattaggattggagccagggtcagtagcccccagttggccgtcttgagggtgtggccactccctaggtcacagaggagatggaggtcaggactcccctgctgcagcgttgttagcaaataatttgccctttggtggcctgaggtgctgtgggggcaggagtgggctgtcttgtggggaagggaaatgtaacgtatcaccaaatctgtgggggagtggggctctgtggggaagatgactcaacctttcaattattctgcttttgagagaattatcttcgctggctctccagggcacaccgtattcagctctgagcggtctttgctagtgaggccaaggagccaccctgagccaaaaggggagcattatgtcaccggaagcccaaccccagagaaccaaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacca

SEQ ID NO: 2985 - DNA, 2339 bp, Homo sapiens
tggcatgagggagaggagtctttcccagaagtccgccctgagaaaccaaggctgggctgctctcctggagccaggggagtccagtgagtgttttacatacaactctaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacca

SEQ ID NO: 2986 - DNA, 3183 bp, Homo sapiens
ggtggcctgggccgagagccaagaaaagagaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccaccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcgtgagtattctgcggagagcgaggggaaggctcagtaggcaatatgccccagagacatgtcctccaaagcgctgggttgccatgtttcttcccagtactatgaaggactgcagaggagttgaggtctacaaatgaggatttattcatcactgtaaacaatgttgatttgatctactttgctaggaaatggtaccacaaaggaaccttttttttttaccctaaaaacctaaactttaggctttctaacttggagaaccatctctttgtatctttttccccatcattaagtagcataactgaaacatattcttttcttggattatttccgtgaagtatacagagttagagaataagagcaaaaaactgtattacttttagcagtgacttgagcattgttcccgggaggaaagagcttttccattccttctgaggtgatgctgctactggtgtctccagtttggactcttgcttactctcttgtccctagagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacca

SEQ ID NO: 2987 - DNA, 1849 bp, Homo sapiens
gaggaaagtgaggtacagagaggttaaatggcttgcccaggattacacagtgtagtaggttttcaactctggtaaaacagctccagcacccataatgcaccacttcccagctcactgtccttgcgggaaaggtgcctgcttcctgttgacctgtgccctcgtgctctgcctcccctacttaccctttttcatacaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacca

SEQ ID NO: 2988 - DNA, 1869 bp, Homo sapiens
ggtggcctgggccgagagccaagaaaagagaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccaccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctggtgttcatgaaaacttgaaggttgtgtggagcagaaggaagagggggtctgatatgcatgttctccgtggcactccttatctaggatttctctagggcaaatgctcattttacctcccacatccccagtggtaactcagcctttaatacttcatggcaagataggattgatgttggaatccagctaaattggatacaaatggtacaatgcagcttggttatgaatgaataaaggactgcaacaggaagcaa

SEQ ID NO: 2989 - DNA, 257 bp, Artificial Sequence
  Synthetic oligonucleotide
ggtggcctgggccgagagccaagaaaagagaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccaccgccgccgcgcttcctcctgaag

SEQ ID NO: 2990 - DNA, 139 bp, Artificial Sequence
  Synthetic oligonucleotide
gtgactgcgcccgcggggacgcagggggcggggcccgggtcgcccggagccgggattgggcagagggcggggcggcggagggattgcggcggcccgcagcgggataaccttgaggctgaggcagtggctccttgcacag

SEQ ID NO: 2991 - DNA, 278 bp, Artificial Sequence
  Synthetic oligonucleotide
gtaagggcatcccttggcttcttaatctacgtactccagacccagggcttggacctttgctggtacgggttaaagtgaggccgacagtgaaggtccacgtggagagagacattgggaagttgtcaaaaaggcgtttagaatcaggtttgactcattaatttcctgagactctgaaggagttcagcctctacacctcagtttcccctgggaaaactgggagtaacattttcctcatgatggttgaaaggattcatgcttacgtggatgtggcacactca

SEQ ID NO: 2992 - DNA, 692 bp, Artificial Sequence
  Synthetic oligonucleotide
gtaagtgtctaatctctggcgaaatacccagaagaaaagcctgtgactgaatatattatttttgagcacaattacttagtccacaattgagcataagggccttgatccattgtcttcctactgtccccaaacgcctacagctaatcgtgaggaatcaggctctctgaataaccacgtgtctcctggaaaccagttccccaagggatctggtttaatattgacaaagtaactgataatgtaactttccaactctctgcttggagcagatgctttttggtcatctgagattgggacctgtagacaaaggcaggcaaggaggggctgagttaagcctttggtgttccgctgtaagtagaatactacctaccagaggaacattccagcccttgacttgctctgcctgctggtgagattaggattggagccagggtcagtagcccccagttggccgtcttgagggtgtggccactccctaggtcacagaggagatggaggtcaggactcccctgctgcagcgttgttagcaaataatttgccctttggtggcctgaggtgctgtgggggcaggagtgggctgtcttgtggggaagggaaatgtaacgtatcaccaaatctgtgggggagtggggctctgtggggaagatgactcaacctttcaattattctgcttttgagagaattatcttcgctgg

SEQ ID NO: 2993 - DNA, 478 bp, Artificial Sequence
  Synthetic oligonucleotide
ctgcggagagcgaggggaaggctcagtaggcaatatgccccagagacatgtcctccaaagcgctgggttgccatgtttcttcccagtactatgaaggactgcagaggagttgaggtctacaaatgaggatttattcatcactgtaaacaatgttgatttgatctactttgctaggaaatggtaccacaaaggaaccttttttttttaccctaaaaacctaaactttaggctttctaacttggagaaccatctctttgtatctttttccccatcattaagtagcataactgaaacatattcttttcttggattatttccgtgaagtatacagagttagagaataagagcaaaaaactgtattacttttagcagtgacttgagcattgttcccgggaggaaagagcttttccattccttctgaggtgatgctgctactggtgtctccagtttggactcttgcttactctcttgtccctag

SEQ ID NO: 2994 - DNA, 196 bp, Artificial Sequence
  Synthetic oligonucleotide
gaggaaagtgaggtacagagaggttaaatggcttgcccaggattacacagtgtagtaggttttcaactctggtaaaacagctccagcacccataatgcaccacttcccagctcactgtccttgcgggaaaggtgcctgcttcctgttgacctgtgccctcgtgctctgcctcccctacttaccctttttcatacag

SEQ ID NO: 2995 - DNA, 251 bp, Artificial Sequence
  Synthetic oligonucleotide
gtgttcatgaaaacttgaaggttgtgtggagcagaaggaagagggggtctgatatgcatgttctccgtggcactccttatctaggatttctctagggcaaatgctcattttacctcccacatccccagtggtaactcagcctttaatacttcatggcaagataggattgatgttggaatccagctaaattggatacaaatggtacaatgcagcttggttatgaatgaataaaggactgcaacaggaagcaa

SEQ ID NO: 2996 - DNA, 69 bp, Artificial Sequence
  Synthetic oligonucleotide
cagctgcacgcgccgtggctccggatctcttcgtctttgcagcgtagcccgagtcggtcagcgccggag

SEQ ID NO: 2997 - DNA, 103 bp, Artificial Sequence
  Synthetic oligonucleotide
gggacaggaagcctcgtaaggtctcaccaggtggcaagcacactggattagaagatgcaggaaagcaccttccagtctgaagatcatttaaagactcagtcat

SEQ ID NO: 2998 - DNA, 108 bp, Artificial Sequence
  Synthetic oligonucleotide
tggcatgagggagaggagtctttcccagaagtccgccctgagaaaccaaggctgggctgctctcctggagccaggggagtccagtgagtgttttacatacaactctag

SEQ ID NO: 2999 - DNA, 117 bp, Artificial Sequence
  Synthetic oligonucleotide
ctctccagggcacaccgtattcagctctgagcggtctttgctagtgaggccaaggagccaccctgagccaaaaggggagcattatgtcaccggaagcccaaccccagagaaccaaag

SEQ ID NO: 3000 - DNA, 45 bp, Artificial Sequence
  Synthetic oligonucleotide
gacctcagcagccatgtcgaagccccatagtgaagccgggactgc

SEQ ID NO: 3001 - DNA, 16 bp, Artificial Sequence
  Synthetic oligonucleotide
cttcattcagacccag

SEQ ID NO: 3002 - DNA, 39 bp, Artificial Sequence
  Synthetic oligonucleotide
cagctgcacgcagccatggctgacacattcctggagcac

SEQ ID NO: 3003 - DNA, 28 bp, Artificial Sequence
  Synthetic oligonucleotide
atgtgccgcctggacattgattcaccac

SEQ ID NO: 3004 - DNA, 4 bp, Artificial Sequence
  Synthetic oligonucleotide
ccat

SEQ ID NO: 3005 - DNA, 15 bp, Artificial Sequence
  Synthetic oligonucleotide
cacagcccggaacac

SEQ ID NO: 3006 - DNA, 20 bp, Artificial Sequence
  Synthetic oligonucleotide
tggcatcatctgtaccattg

SEQ ID NO: 3007 - DNA, 26 bp, Artificial Sequence
  Synthetic oligonucleotide
gcccagcttcccgatcagtggagacg

SEQ ID NO: 3008 - DNA, 21 bp, Artificial Sequence
  Synthetic oligonucleotide
ttgaaggagatgattaagtct

SEQ ID NO: 3009 - DNA, 45 bp, Artificial Sequence
  Synthetic oligonucleotide
ggaatgaatgtggctcgtctgaacttctctcatggaactcatgag

SEQ ID NO: 3010 - DNA, 63 bp, Artificial Sequence
  Synthetic oligonucleotide
taccatgcggagaccatcaagaatgtgcgcacagccacggaaagctttgcttctgaccccatc

SEQ ID NO: 3011 - DNA, 40 bp, Artificial Sequence
  Synthetic oligonucleotide
ctctaccggcccgttgctgtggctctagacactaaaggac

SEQ ID NO: 3012 - DNA, 29 bp, Artificial Sequence
  Synthetic oligonucleotide
ctgagatccgaactgggctcatcaagggc

SEQ ID NO: 3013 - DNA, 9 bp, Artificial Sequence
  Synthetic oligonucleotide
gtgagtatt

SEQ ID NO: 3014 - DNA, 15 bp, Artificial Sequence
  Synthetic oligonucleotide
agcggcactgcagag

SEQ ID NO: 3015 - DNA, 6 bp, Artificial Sequence
  Synthetic oligonucleotide
gtggag

SEQ ID NO: 3016 - DNA, 9 bp, Artificial Sequence
  Synthetic oligonucleotide
ctgaagaag

SEQ ID NO: 3017 - DNA, 21 bp, Artificial Sequence
  Synthetic oligonucleotide
ggagccactctcaaaatcacg

SEQ ID NO: 3018 - DNA, 11 bp, Artificial Sequence
  Synthetic oligonucleotide
ctggataacgc

SEQ ID NO: 3019 - DNA, 28 bp, Artificial Sequence
  Synthetic oligonucleotide
ctacatggaaaagtgtgacgagaacatc

SEQ ID NO: 3020 - DNA, 11 bp, Artificial Sequence
  Synthetic oligonucleotide
ctgtggctgga

SEQ ID NO: 3021 - DNA, 12 bp, Artificial Sequence
  Synthetic oligonucleotide
ctacaagaacat

SEQ ID NO: 3022 - DNA, 7 bp, Artificial Sequence
  Synthetic oligonucleotide
ctgcaag

SEQ ID NO: 3023 - DNA, 9 bp, Artificial Sequence
  Synthetic oligonucleotide
gtggtggaa

SEQ ID NO: 3024 - DNA, 14 bp, Artificial Sequence
  Synthetic oligonucleotide
gtgggcagcaagat

SEQ ID NO: 3025 - DNA, 4 bp, Artificial Sequence
  Synthetic oligonucleotide
ctac

SEQ ID NO: 3026 - DNA, 27 bp, Artificial Sequence
  Synthetic oligonucleotide
gtggatgatgggcttatttctctccag

SEQ ID NO: 3027 - DNA, 13 bp, Artificial Sequence
  Synthetic oligonucleotide
gtgaagcagaaag

SEQ ID NO: 3028 - DNA, 11 bp, Artificial Sequence
  Synthetic oligonucleotide
gtgccgacttc

SEQ ID NO: 3029 - DNA, 15 bp, Artificial Sequence
  Synthetic oligonucleotide
ctggtgacggaggtg

SEQ ID NO: 3030 - DNA, 14 bp, Artificial Sequence
  Synthetic oligonucleotide
gaaaatggtggctc

SEQ ID NO: 3031 - DNA, 9 bp, Artificial Sequence
  Synthetic oligonucleotide
cttgggcag

SEQ ID NO: 3032 - DNA, 8 bp, Artificial Sequence
  Synthetic oligonucleotide
caagaagg

SEQ ID NO: 3033 - DNA, 29 bp, Artificial Sequence
  Synthetic oligonucleotide
gtgtgaaccttcctggggctgctgtggac

SEQ ID NO: 3034 - DNA, 4 bp, Artificial Sequence
  Synthetic oligonucleotide
ttgc

SEQ ID NO: 3035 - DNA, 50 bp, Artificial Sequence
  Synthetic oligonucleotide
ctgctgtgtcggagaaggacatccaggatctgaagtttggggtcgagcag

SEQ ID NO: 3036 - DNA, 40 bp, Artificial Sequence
  Synthetic oligonucleotide
gatgttgatatggtgtttgcgtcattcatccgcaaggcat

SEQ ID NO: 3037 - DNA, 14 bp, Artificial Sequence
  Synthetic oligonucleotide
ctgatgtccatgaa

SEQ ID NO: 3038 - DNA, 12 bp, Artificial Sequence
  Synthetic oligonucleotide
gttaggaaggtc

SEQ ID NO: 3039 - DNA, 12 bp, Artificial Sequence
  Synthetic oligonucleotide
ctgggagagaag

SEQ ID NO: 3040 - DNA, 11 bp, Artificial Sequence
  Synthetic oligonucleotide
ggaaagaacat

SEQ ID NO: 3041 - DNA, 12 bp, Artificial Sequence
  Synthetic oligonucleotide
caagattatcag

SEQ ID NO: 3042 - DNA, 9 bp, Artificial Sequence
  Synthetic oligonucleotide
caaaatcga

SEQ ID NO: 3043 - DNA, 21 bp, Artificial Sequence
  Synthetic oligonucleotide
gaatcatgagggggttcggag

SEQ ID NO: 3044 - DNA, 21 bp, Artificial Sequence
  Synthetic oligonucleotide
gtttgatgaaatcctggaggc

SEQ ID NO: 3045 - DNA, 26 bp, Artificial Sequence
  Synthetic oligonucleotide
cagtgatgggatcatggtggctcgtg

SEQ ID NO: 3046 - DNA, 104 bp, Artificial Sequence
  Synthetic oligonucleotide
gtgatctaggcattgagattcctgcagagaaggtcttccttgctcagaagatgatgattggacggtgcaaccgagctgggaagcctgtcatctgtgctactcag

SEQ ID NO: 3047 - DNA, 15 bp, Artificial Sequence
  Synthetic oligonucleotide
atgctggagagcatg

SEQ ID NO: 3048 - DNA, 6 bp, Artificial Sequence
  Synthetic oligonucleotide
atcaag

SEQ ID NO: 3049 - DNA, 48 bp, Artificial Sequence
  Synthetic oligonucleotide
aagccccgccccactcgggctgaaggcagtgatgtggccaatgcagtc

SEQ ID NO: 3050 - DNA, 7 bp, Artificial Sequence
  Synthetic oligonucleotide
ctggatg

SEQ ID NO: 3051 - DNA, 17 bp, Artificial Sequence
  Synthetic oligonucleotide
gagccgactgcatcatg

SEQ ID NO: 3052 - DNA, 60 bp, Artificial Sequence
  Synthetic oligonucleotide
ctgtctggagaaacagccaaaggggactatcctctggaggctgtgcgcatgcagcacctg

SEQ ID NO: 3053 - DNA, 16 bp, Artificial Sequence
  Synthetic oligonucleotide
attgcccgtgaggcag

SEQ ID NO: 3054 - DNA, 10 bp, Artificial Sequence
  Synthetic oligonucleotide
aggctgccat

SEQ ID NO: 3055 - DNA, 7 bp, Artificial Sequence
  Synthetic oligonucleotide
ctaccac

SEQ ID NO: 3056 - DNA, 62 bp, Artificial Sequence
  Synthetic oligonucleotide
ttgcaattatttgaggaactccgccgcctggcgcccattaccagcgaccccacagaagccac

SEQ ID NO: 3057 - DNA, 8 bp, Artificial Sequence
  Synthetic oligonucleotide
cgccgtgg

SEQ ID NO: 3058 - DNA, 11 bp, Artificial Sequence
  Synthetic oligonucleotide
gtgccgtggag

SEQ ID NO: 3059 - DNA, 14 bp, Artificial Sequence
  Synthetic oligonucleotide
gcctccttcaagtg

SEQ ID NO: 3060 - DNA, 5 bp, Artificial Sequence
  Synthetic oligonucleotide
ctgca

SEQ ID NO: 3061 - DNA, 12 bp, Artificial Sequence
  Synthetic oligonucleotide
gtggggccataa

SEQ ID NO: 3062 - DNA, 15 bp, Artificial Sequence
  Synthetic oligonucleotide
tcgtcctcaccaagt

SEQ ID NO: 3063 - DNA, 7 bp, Artificial Sequence
  Synthetic oligonucleotide
ctggcag

SEQ ID NO: 3064 - DNA, 13 bp, Artificial Sequence
  Synthetic oligonucleotide
gtctgctcaccag

SEQ ID NO: 3065 - DNA, 30 bp, Artificial Sequence
  Synthetic oligonucleotide
gtggccagataccgcccacgtgcccccatc

SEQ ID NO: 3066 - DNA, 42 bp, Artificial Sequence
  Synthetic oligonucleotide
attgctgtgacccggaatccccagacagctcgtcaggcccac

SEQ ID NO: 3067 - DNA, 11 bp, Artificial Sequence
  Synthetic oligonucleotide
ctgtaccgtgg

SEQ ID NO: 3068 - DNA, 86 bp, Artificial Sequence
  Synthetic oligonucleotide
catcttccctgtgctgtgcaaggacccagtccaggaggcctgggctgaggacgtggacctccgggtgaactttgccatgaatgttg

SEQ ID NO: 3069 - DNA, 60 bp, Artificial Sequence
  Synthetic oligonucleotide
gcaaggcccgaggcttcttcaagaagggagatgtggtcattgtgctgaccggatggcgcc

SEQ ID NO: 3070 - DNA, 7 bp, Artificial Sequence
  Synthetic oligonucleotide
ctggctc

SEQ ID NO: 3071 - DNA, 13 bp, Artificial Sequence
  Synthetic oligonucleotide
cggcttcaccaac

SEQ ID NO: 3072 - DNA, 66 bp, Artificial Sequence
  Synthetic oligonucleotide
accatgcgtgttgttcctgtgccgtgatggaccccagagcccctcctccagcccctgtcccacccc

SEQ ID NO: 3073 - DNA, 27 bp, Artificial Sequence
  Synthetic oligonucleotide
cttcccccagcccatccattaggccag

SEQ ID NO: 3074 - DNA, 5 bp, Artificial Sequence
  Synthetic oligonucleotide
caacg

SEQ ID NO: 3075 - DNA, 15 bp, Artificial Sequence
  Synthetic oligonucleotide
cttgtagaactcact

SEQ ID NO: 3076 - DNA, 25 bp, Artificial Sequence
  Synthetic oligonucleotide
ctgggctgtaacgtggcactggtag

SEQ ID NO: 3077 - DNA, 13 bp, Artificial Sequence
  Synthetic oligonucleotide
gttgggacaccag

SEQ ID NO: 3078 - DNA, 8 bp, Artificial Sequence
  Synthetic oligonucleotide
ggaagaag

SEQ ID NO: 3079 - DNA, 41 bp, Artificial Sequence
  Synthetic oligonucleotide
atcaacgcctcactgaaacatggctgtgtttgcagcctgct

SEQ ID NO: 3080 - DNA, 4 bp, Artificial Sequence
  Synthetic oligonucleotide
ctag

SEQ ID NO: 3081 - DNA, 8 bp, Artificial Sequence
  Synthetic oligonucleotide
tgggacag

SEQ ID NO: 3082 - DNA, 20 bp, Artificial Sequence
  Synthetic oligonucleotide
cccagagcctggctgcccat

SEQ ID NO: 3083 - DNA, 13 bp, Artificial Sequence
  Synthetic oligonucleotide
catgtggccccac

SEQ ID NO: 3084 - DNA, 9 bp, Artificial Sequence
  Synthetic oligonucleotide
ccaatcaag

SEQ ID NO: 3085 - DNA, 16 bp, Artificial Sequence
  Synthetic oligonucleotide
ggaagaaggaggaatg

SEQ ID NO: 3086 - DNA, 25 bp, Artificial Sequence
  Synthetic oligonucleotide
ctggactggaggcccctggagccag

SEQ ID NO: 3087 - DNA, 32 bp, Artificial Sequence
  Synthetic oligonucleotide
atggcaagagggtgacagcttcctttcctgtg

SEQ ID NO: 3088 - DNA, 6 bp, Artificial Sequence
  Synthetic oligonucleotide
tgtact

SEQ ID NO: 3089 - DNA, 11 bp, Artificial Sequence
  Synthetic oligonucleotide
ctgtccagttc

SEQ ID NO: 3090 - DNA, 6 bp, Artificial Sequence
  Synthetic oligonucleotide
ctttag

SEQ ID NO: 3091 - DNA, 29 bp, Artificial Sequence
  Synthetic oligonucleotide
aaaaaatggatgcccagaggactcccaac

SEQ ID NO: 3092 - DNA, 17 bp, Artificial Sequence
  Synthetic oligonucleotide
cctggcttggggtcaag

SEQ ID NO: 3093 - DNA, 10 bp, Artificial Sequence
  Synthetic oligonucleotide
aaacagccag

SEQ ID NO: 3094 - DNA, 4 bp, Artificial Sequence
  Synthetic oligonucleotide
caag

SEQ ID NO: 3095 - DNA, 10 bp, Artificial Sequence
  Synthetic oligonucleotide
agttaggggc

SEQ ID NO: 3096 - DNA, 23 bp, Artificial Sequence
  Synthetic oligonucleotide
cttagggcactgggctgttgttc

SEQ ID NO: 3097 - DNA, 43 bp, Artificial Sequence
  Synthetic oligonucleotide
cattgaagccgactctggccctggcccttacttgcttctctag

SEQ ID NO: 3098 - DNA, 46 bp, Artificial Sequence
  Synthetic oligonucleotide
ctctctaggcctctccagtttgcacctgtccccaccctccactcag

SEQ ID NO: 3099 - DNA, 5 bp, Artificial Sequence
  Synthetic oligonucleotide
ctgtc

SEQ ID NO: 3100 - DNA, 6 bp, Artificial Sequence
  Synthetic oligonucleotide
ctgcag

SEQ ID NO: 3101 - DNA, 5 bp, Artificial Sequence
  Synthetic oligonucleotide
caaac

SEQ ID NO: 3102 - DNA, 7 bp, Artificial Sequence
  Synthetic oligonucleotide
actccac

SEQ ID NO: 3103 - DNA, 7 bp, Artificial Sequence
  Synthetic oligonucleotide
cctccac

SEQ ID NO: 3104 - DNA, 12 bp, Artificial Sequence
  Synthetic oligonucleotide
cttccattttcc

SEQ ID NO: 3105 - DNA, 5 bp, Artificial Sequence
  Synthetic oligonucleotide
cccac

SEQ ID NO: 3106 - DNA, 19 bp, Artificial Sequence
  Synthetic oligonucleotide
tactgcagcacctccaggc

SEQ ID NO: 3107 - DNA, 7 bp, Artificial Sequence
  Synthetic oligonucleotide
ctgttgc

SEQ ID NO: 3108 - DNA, 44 bp, Artificial Sequence
  Synthetic oligonucleotide
tatagagcctacctgtatgtcaataaacaacagctgaagcacca

SEQ ID NO: 3109 - DNA, 1940 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3110 - DNA, 3047 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3111 - DNA, 3023 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3112 - DNA, 3691 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagataaaaagaatttaccttcgttgaaaacaagattggcaaaagaaagataaaaatgaaaggaaaagataattgttgaagctgggggctggggttatgagcacacggagttcattaaacgtattctccctatttaaaaaaaaaaaaaaaaaaaaaagcccaacgcggatgctgagactgttgtcccagctactctggaggctgagacgggaggatcgcttgagctcaggagttctggtctgtcgtgcgctatgctgatatggtgtccacactaagttgggcatcaatatggtgacctcccggagacgggggccattaggttccctaaggaggggtgaacaagtccaggtctgaaaccaaacaggtcataactccagtgctgatcaatagcagaaccgttcctgggaatagccactgcacttcagcctgggcaacatagcgagactctgtctcttaaaaaaaaaaataaaaattaaatttaagcccggcgcggtggctcacgcctgtaatccaagtactttgggaggccgaggccgggggtcacttgaggtccggagttcgagaccagcctggtcaacatggcgaaacccccgtctctactaatacaaaaaaaattagttgggtgtgatatcgcacgcctgtaatccca

SEQ ID NO: 3113 - DNA, 3697 bp, Homo sapiens
acccaggctggagtgcagtggcgtgatgtcggctcactgcaacctctgcctcctgggttcagtgattctcctgcctcatccttccaagtagctgggactacaggtgtgcaccaccacacctggcaatatatatatatatatatatagcattttcagtagaaacggggtttcaccatgttgcccaggctggtctcaaactcctgatctcaagtgatccgcccacctcggcctcccaaattgctgggattacaggcatgagccaccacacccagcctgagttctgtatatattctggatattagcctgatttttaaaatccttgatccctggaaggactgcgtgagtcaattctagtcccatgccactggtatcgaaggacgcctgagcagagggaagcactttgcgagtgtgtttacccctagtccacagaggcagaaacagatatgctgtccaggatcccgaggcagcccagtcattattacatctttattgaggttttacaaagtgccaggcaccatgctaatggatctgcatatgttatctcatttcctccctgcagcagccgtgggaagtaggtgttattattatccacattttaaagacgaggaaactaaacctcattacttatgacttacgtatttaatgagttactgaaatcgtaaagtaacttccacaaggtcaggcagctactaagcttcagagtttcagctgtaacctggtcttgcaactctgaagtgggtgcaactgcctcccaaacagaattcaaactttcacttcccagccccttgagttcatttccacaagtgtctggacactagaggggagagaacagtttgggactgggtcagggagggccggaggaggagaagggactttgcctccagtctcactgtcacgtggctgctctcccctcctgccagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3114 - DNA, 3120 bp, Homo sapiens
cagggatgagaggcctctgtgtggtgggggcggactctgaggaggcctctgccctctgcctggccctcccccagcctcctgcaggtgtccgagcagcaggggccctgcgggcaggggcatgacccttacagcaatggtggctggccctgtcacagctaatgaccctgacggcccaggctgggaaggaggtggggtgtggagagaggaagggaaggcagaggatgcctctgtgtgtgtgagcagggtgtttggggtgagacccctactcacccccgcccctcccccagcctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3115 - DNA, 4617 bp, Homo sapiens
gtgacttaggcattcccctcccccgggggaggtgggctaaagaggcctgagactttaaggctgatttcactgcagtggctgagagaggattggctagaaaggaggagacactagaaagagtggaggcagcctggggagctgaccctgccaacatctaccttgggaaagaagggtcccctgtgcctcccgtggagctagaatggttccccaagggccttggctcccggctggggaggaggtatcctggagcttcatctgtttgggcaggtgtggcatgcaagatgccagctctcccgggggcttataaaaatgagggtctctcctgcctgccctgcatccctttgcttgcacaatccactagcaatccagacaatctgatccaaacaccatgtgggtgtgggagtgctgtggctgtttggagttttttttaattgatgggaagggtaatgcccaagcctctgtctcctaccctttctcgttgaggagtcttcctatgcccaacagccccttagcccagtacatcctctttctcttctactctctgccttctcaggaagtatggctggtgctaggggtgcaaccctttaggctggtcaatgggactctcatttggtttggaggcttgggaaggtcgggagggggcacacaatggttctgatgtgggaagtatgagaaggagcagatggggtcagttaacacctttcataatccatccacaaagatttctttttcttctttttttctttttttttttttttttttttgagacaggatcttactctgtcacccaggctggagtgcaataatagcatgatcagagctcaccgcagcctcaacctccctgggctcaggtgatcctcccacctcagcctcctgagagctgggaccacaggcacgttccaccatgcccagctaatttttaaatttttctgtagagacgaggcttcaccatattgcccaggctggtctcgaactcctgggctcaagtgatccacccacctcagcctcccagagtgctgggattacaggtgtgagccactgtagctgtccaaatatttcttgagtgtgtaccatattcccagcactattccatgaagtgggacacaacgatgagcaccacagatgatgtcttgccctcctggaggtgacaggtcttactgcacctgaagcgagcctgtgcatgccagcccactgcccctctttctgttccacgaaggccctggatgagtcctttctctcctctgccagaagtgccctttccccagctccctgggggctggcaccccttgaccctgaaggctcagctcaaacggcccttcccataagatgcttcctccaagcgcacccagtctggtcttccctcccactctcgttcacccatcctgatctttcccttaggagcacccactgcagtttgtaattatgttatttgctctgtatccttcttttagcctgtaggcacttcacattttcatttgtcactttcatttgcctagcttagtacatagaaggcatccatgcagtagatatgcttgaagaaaggaagcagggagggaaggaagaaggcagatctcagaggaaaggagaggaagaagtggagagccaggccaaacctcgaagtcctccagcacccaaaggtctgagagcgaggagtgtgagtcttcagaggaggctgacaggcggccccagagggaagcttccaaaggacagtgcacccaggctctgagtgtagccatcggaggccactgaagccagagtggagaaggccaaggagagggtggaagcctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3116 - DNA, 3007 bp, Homo sapiens
agtgtctgcaaagtctctggaaggcccatggaaggagcgccctttgggtcttctgatccagccctctgcctgtggcaatgcacccgcttccctctccagggtcaaggcgaacatcccagggttgcagagtgggccataatcgctgagcgctgcaggataccgtcttgaactgtgcctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3117 - DNA, 3728 bp, Homo sapiens
gtgacttaggcattcccctcccccgggggaggtgggctaaagaggcctgagactttaaggctgatttcactgcagtggctgagagaggattggctagaaaggaggagacactagaaagagtggaggcagcctggggagctgaccctgccaacatctaccttgggaaagaagggtcccctgtgcctcccgtggagctagaatggttccccaagggccttggctcccggctggggaggaggtatcctggagcttcatctgtttgggcaggtgtggcatgcaagatgccagctctcccgggggcttataaaaatgagggtctctcctgcctgccctgcatccctttgcttgcacaatccactagcaatccagacaatctgatccaaacaccatgtgggtgtgggagtgctgtggctgtttggagttttttttaattgatgggaagggtaatgcccaagcctctgtctcctaccctttctcgttgaggagtcttcctatgcccaacagccccttagcccagtacatcctctttctcttctactctctgccttctcaggaagtatggctggtgctaggggtgcaaccctttaggctggtcaatgggactctcatttggtttggaggcttgggaaggtcgggagggggcacacaatggttctgatgtgggaagtatgagaaggagcagatggggtcagttaacacctttcataatccatccacaaagatttctttttcttctttttttctttttttttttttttttttttgagacaggatcttactctgtcacccaggctggagtgcaataatagcatgatcagagctcaccgcagcctcaacctccctgggctcaggtgatcctcccacctcagcctcctgagagctgggaccacaggcacgttccaccatgcccagctaatttttaaatttttctgtagagacgaggcttcaccatattgcccaggctggtctcgaactcctgggctcaagtgatccacccacctcagcctcccagagtgctgggattacaggtgtgagccactgtagctgtccaaatatttcttgagtgtgtaccatattcccagcactattccatgaagtgggacacaacgatgagcaccacagatgatgtcttgccctcctggaggtgacaggtcttactgcacctgaagcgagcctgtgcatgccagcccactgcccctctttctgttccacgaaggccctggatgagtcctttctctcctctgccagaagtgccctttccccagctccctgggggctggcaccccttgaccctgaaggctcagctcaaacggcccttcccataagatgcttcctccaagcgcacccagtctggtcttccctcccactctcgttcacccatcctgatctttcccttaggagcacccactgcagtttgtaattatgttatttgctctgtatccttcttttagcctgtaggcacttcacattttcatttgtcactttcatttgcctagcttagtacatagaaggcatccatgcagtagatatgcttgaagaaaggaagcagggagggaaggaagaaggcagatctcagaggaaaggagaggaagaagtggagagccaggccaaacctcgaagtcctccagcacccaaaggtctgagagcgaggagtgtgagtcttcagaggaggctgacaggcggccccagagggaagcttccaaaggacagtgcacccaggctctgagtgtagccatcggaggccactgaagccagagtggagaaggccaaggagagggtggaagcctacaggactgtgtgcagcgtgaacgggcccctggtggtgctggaccgggtcaagtggcatggacgtacctaacctcctcagaggaaggctggaccacagcacggctgtacctaacctcctcgagggctagactctccccaccctcgactctcacaggatcttcttttaacgggaaagaggaggaggtggcaagtcaatgccaactaaattttctagggatcttgatggcctccaaaggcctttggaatatctcagtctcagcaacatgggtgtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3118 - DNA, 1961 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaggagacttagtagactggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3119 - DNA, 3306 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacggtagcctcctcacagcccactaccctccagagctcccctgtcctcccttttccaaccagatacttaaagggcccacgttgctttgcacagatgtgcagcagcacttttcctccatcgagatagacactgccctttcctccaccatccatgccccccacacatccctatcactcccatgagggaaacagaccccaggtggccctgagtggttggagacctgggcccccacccacactgaggccagtgagttttcttgtagatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3120 - DNA, 3089 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcggccgtgtggagggtcggggaggatccatcacacagatccccatcctcaccatgcccaacgacgatatcacccaccctatcccagacttgacgggcttcatcacagagggacagatctacgtggacagacagcttcacaacagacaggttaaaggtgacctctatgacgtttttctctttgcttggcagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3121 - DNA, 1790 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggagatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3122 - DNA, 2136 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcatttccctaaacatttatttagaaaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtctcgcggctagaaaggggtgct

SEQ ID NO: 3123 - DNA, 1029 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctcgcggctagaaaggggtgct

SEQ ID NO: 3124 - DNA, 1776 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttcccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3125 - DNA, 741 bp, Homo sapiens
agtcctgctgtccaccactccctttttcttctccctcagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3126 - DNA, 776 bp, Homo sapiens
gtccgggggctggtaggtcctctagtttccgaagctgaaggcctgagccccatctgaaggacaagcttttctcctggcaaaattcctttccgaacggggtcccagtgtggccaggttgggggctactggactcccgtggtaagcccgcagcggccaccgacgccttgcccctcccccagtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagat

SEQ ID NO: 3127 - DNA, 1385 bp, Homo sapiens
agtcctgctgtccaccactccctttttcttctccctcagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagataaaaagaatttaccttcgttgaaaacaagattggcaaaagaaagataaaaatgaaaggaaaagataattgttgaagctgggggctggggttatgagcacacggagttcattaaacgtattctccctatttaaaaaaaaaaaaaaaaaaaaaagcccaacgcggatgctgagactgttgtcccagctactctggaggctgagacgggaggatcgcttgagctcaggagttctggtctgtcgtgcgctatgctgatatggtgtccacactaagttgggcatcaatatggtgacctcccggagacgggggccattaggttccctaaggaggggtgaacaagtccaggtctgaaaccaaacaggtcataactccagtgctgatcaatagcagaaccgttcctgggaatagccactgcacttcagcctgggcaacatagcgagactctgtctcttaaaaaaaaaaataaaaattaaatttaagcccggcgcggtggctcacgcctgtaatccaagtactttgggaggccgaggccgggggtcacttgaggtccggagttcgagaccagcctggtcaacatggcgaaacccccgtctctactaatacaaaaaaaattagttgggtgtgatatcgcacgcctgtaatccca

SEQ ID NO: 3128 - DNA, 1420 bp, Homo sapiens
gtccgggggctggtaggtcctctagtttccgaagctgaaggcctgagccccatctgaaggacaagcttttctcctggcaaaattcctttccgaacggggtcccagtgtggccaggttgggggctactggactcccgtggtaagcccgcagcggccaccgacgccttgcccctcccccagtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagataaaaagaatttaccttcgttgaaaacaagattggcaaaagaaagataaaaatgaaaggaaaagataattgttgaagctgggggctggggttatgagcacacggagttcattaaacgtattctccctatttaaaaaaaaaaaaaaaaaaaaaagcccaacgcggatgctgagactgttgtcccagctactctggaggctgagacgggaggatcgcttgagctcaggagttctggtctgtcgtgcgctatgctgatatggtgtccacactaagttgggcatcaatatggtgacctcccggagacgggggccattaggttccctaaggaggggtgaacaagtccaggtctgaaaccaaacaggtcataactccagtgctgatcaatagcagaaccgttcctgggaatagccactgcacttcagcctgggcaacatagcgagactctgtctcttaaaaaaaaaaataaaaattaaatttaagcccggcgcggtggctcacgcctgtaatccaagtactttgggaggccgaggccgggggtcacttgaggtccggagttcgagaccagcctggtcaacatggcgaaacccccgtctctactaatacaaaaaaaattagttgggtgtgatatcgcacgcctgtaatccca

SEQ ID NO: 3129 - DNA, 214 bp, Artificial Sequence
  Synthetic oligonucleotide
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtca

SEQ ID NO: 3130 - DNA, 267 bp, Artificial Sequence
  Synthetic oligonucleotide
gtgacttaggcattcccctcccccgggggaggtgggctaaagaggcctgagactttaaggctgatttcactgcagtggctgagagaggattggctagaaaggaggagacactagaaagagtggaggcagcctggggagctgaccctgccaacatctaccttgggaaagaagggtcccctgtgcctcccgtggagctagaatggttccccaagggccttggctcccggctggggaggaggtatcctggagcttcatctgtttgggcag

SEQ ID NO: 3131 - DNA, 174 bp, Artificial Sequence
  Synthetic oligonucleotide
agtgtctgcaaagtctctggaaggcccatggaaggagcgccctttgggtcttctgatccagccctctgcctgtggcaatgcacccgcttccctctccagggtcaaggcgaacatcccagggttgcagagtgggccataatcgctgagcgctgcaggataccgtcttgaactgtg

SEQ ID NO: 3132 - DNA, 482 bp, Artificial Sequence
  Synthetic oligonucleotide
gtgtggcatgcaagatgccagctctcccgggggcttataaaaatgagggtctctcctgcctgccctgcatccctttgcttgcacaatccactagcaatccagacaatctgatccaaacaccatgtgggtgtgggagtgctgtggctgtttggagttttttttaattgatgggaagggtaatgcccaagcctctgtctcctaccctttctcgttgaggagtcttcctatgcccaacagccccttagcccagtacatcctctttctcttctactctctgccttctcaggaagtatggctggtgctaggggtgcaaccctttaggctggtcaatgggactctcatttggtttggaggcttgggaaggtcgggagggggcacacaatggttctgatgtgggaagtatgagaaggagcagatggggtcagttaacacctttcataatccatccacaaagatttctttttcttctttttttctttttt

SEQ ID NO: 3133 - DNA, 1035 bp, Artificial Sequence
  Synthetic oligonucleotide
tttttttttttttttgagacaggatcttactctgtcacccaggctggagtgcaataatagcatgatcagagctcaccgcagcctcaacctccctgggctcaggtgatcctcccacctcagcctcctgagagctgggaccacaggcacgttccaccatgcccagctaatttttaaatttttctgtagagacgaggcttcaccatattgcccaggctggtctcgaactcctgggctcaagtgatccacccacctcagcctcccagagtgctgggattacaggtgtgagccactgtagctgtccaaatatttcttgagtgtgtaccatattcccagcactattccatgaagtgggacacaacgatgagcaccacagatgatgtcttgccctcctggaggtgacaggtcttactgcacctgaagcgagcctgtgcatgccagcccactgcccctctttctgttccacgaaggccctggatgagtcctttctctcctctgccagaagtgccctttccccagctccctgggggctggcaccccttgaccctgaaggctcagctcaaacggcccttcccataagatgcttcctccaagcgcacccagtctggtcttccctcccactctcgttcacccatcctgatctttcccttaggagcacccactgcagtttgtaattatgttatttgctctgtatccttcttttagcctgtaggcacttcacattttcatttgtcactttcatttgcctagcttagtacatagaaggcatccatgcagtagatatgcttgaagaaaggaagcagggagggaaggaagaaggcagatctcagaggaaaggagaggaagaagtggagagccaggccaaacctcgaagtcctccagcacccaaaggtctgagagcgaggagtgtgagtcttcagaggaggctgacaggcggccccagagggaagcttccaaaggacagtgcacccaggctctgagtgtagccatcggaggccactgaagccagagtggagaaggccaaggagagggtggaag

SEQ ID NO: 3134 - DNA, 287 bp, Artificial Sequence
  Synthetic oligonucleotide
cagggatgagaggcctctgtgtggtgggggcggactctgaggaggcctctgccctctgcctggccctcccccagcctcctgcaggtgtccgagcagcaggggccctgcgggcaggggcatgacccttacagcaatggtggctggccctgtcacagctaatgaccctgacggcccaggctgggaaggaggtggggtgtggagagaggaagggaaggcagaggatgcctctgtgtgtgtgagcagggtgtttggggtgagacccctactcacccccgcccctcccccag

SEQ ID NO: 3135 - DNA, 218 bp, Artificial Sequence
  Synthetic oligonucleotide
tggcatggacgtacctaacctcctcagaggaaggctggaccacagcacggctgtacctaacctcctcgagggctagactctccccaccctcgactctcacaggatcttcttttaacgggaaagaggaggaggtggcaagtcaatgccaactaaattttctagggatcttgatggcctccaaaggcctttggaatatctcagtctcagcaacatgggtg

SEQ ID NO: 3136 - DNA, 920 bp, Artificial Sequence
  Synthetic oligonucleotide
acccaggctggagtgcagtggcgtgatgtcggctcactgcaacctctgcctcctgggttcagtgattctcctgcctcatccttccaagtagctgggactacaggtgtgcaccaccacacctggcaatatatatatatatatatatagcattttcagtagaaacggggtttcaccatgttgcccaggctggtctcaaactcctgatctcaagtgatccgcccacctcggcctcccaaattgctgggattacaggcatgagccaccacacccagcctgagttctgtatatattctggatattagcctgatttttaaaatccttgatccctggaaggactgcgtgagtcaattctagtcccatgccactggtatcgaaggacgcctgagcagagggaagcactttgcgagtgtgtttacccctagtccacagaggcagaaacagatatgctgtccaggatcccgaggcagcccagtcattattacatctttattgaggttttacaaagtgccaggcaccatgctaatggatctgcatatgttatctcatttcctccctgcagcagccgtgggaagtaggtgttattattatccacattttaaagacgaggaaactaaacctcattacttatgacttacgtatttaatgagttactgaaatcgtaaagtaacttccacaaggtcaggcagctactaagcttcagagtttcagctgtaacctggtcttgcaactctgaagtgggtgcaactgcctcccaaacagaattcaaactttcacttcccagccccttgagttcatttccacaagtgtctggacactagaggggagagaacagtttgggactgggtcagggagggccggaggaggagaagggactttgcctccagtctcactgtcacgtggctgctctcccctcctgccag

SEQ ID NO: 3137 - DNA, 140 bp, Artificial Sequence
  Synthetic oligonucleotide
gccagcccatcaacccgcactcccgcatctaccccgaggagatgattcagacgggcatttctcctattgacgtcatgaacagcattgcccgcggccagaagatccccatcttctcagcagccgggctcccccacaatgag

SEQ ID NO: 3138 - DNA, 313 bp, Artificial Sequence
  Synthetic oligonucleotide
gtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatc

SEQ ID NO: 3139 - DNA, 446 bp, Artificial Sequence
  Synthetic oligonucleotide
aaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcactccacgtgggaagggttcatagggctggcaagcatagggacgagcacattaggtgtgctttgagcagtgaaagggacagtgagaggagcagtgagagggacgaaaccatccagaggacatggagtgagggtgctccagctgacccaagtgtgggtgccctaggataagacagagctaaagcaggtgcccccaactcatctacagtgtgatatgccagagtccttccc

SEQ ID NO: 3140 - DNA, 324 bp, Artificial Sequence
  Synthetic oligonucleotide
cttcggtccacaggggacaaaagccactctcatcttcatcaggcactcctggccctgcctggcttttcccacccaacttgcctcctggcctcagcccctgtcccctttcctaccttggacagtaggcgaggtgtgtgttggaatctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccag

SEQ ID NO: 3141 - DNA, 124 bp, Artificial Sequence
  Synthetic oligonucleotide
gatcgagcggatcatcaccccgcgcctggcgctgaccactgctgaattccttgcctaccagtgtgagaagcatgtgctggtcatactgacggacatgagttcctatgcagaggccttgcgggag

SEQ ID NO: 3142 - DNA, 259 bp, Artificial Sequence
  Synthetic oligonucleotide
gtagcctcctcacagcccactaccctccagagctcccctgtcctcccttttccaaccagatacttaaagggcccacgttgctttgcacagatgtgcagcagcacttttcctccatcgagatagacactgccctttcctccaccatccatgccccccacacatccctatcactcccatgagggaaacagaccccaggtggccctgagtggttggagacctgggcccccacccacactgaggccagtgagttttcttgtag

SEQ ID NO: 3143 - DNA, 179 bp, Artificial Sequence
  Synthetic oligonucleotide
gtccgggggctggtaggtcctctagtttccgaagctgaaggcctgagccccatctgaaggacaagcttttctcctggcaaaattcctttccgaacggggtcccagtgtggccaggttgggggctactggactcccgtggtaagcccgcagcggccaccgacgccttgcccctcccccag

SEQ ID NO: 3144 - DNA, 130 bp, Artificial Sequence
  Synthetic oligonucleotide
tacgcctgctatgccatcgggaaggacgtgcaggccatgaaggcagtagttggggaggaggcgctcacctctgaggacctgctctacctggaattcctgcagaagtttgagaagaacttcatcaatcagg

SEQ ID NO: 3145 - DNA, 331 bp, Artificial Sequence
  Synthetic oligonucleotide
gcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattcc

SEQ ID NO: 3146 - DNA, 780 bp, Artificial Sequence
  Synthetic oligonucleotide
ttttcccgcgctccatgcctccccctcgactcccggtgctgcggaagaactgaaggttgcgatgccttactctgacgggagcatctgtatttttatgttaaaagcccacaaaataaaaataaaaagtaactgagataaaaagaatttaccttcgttgaaaacaagattggcaaaagaaagataaaaatgaaaggaaaagataattgttgaagctgggggctggggttatgagcacacggagttcattaaacgtattctccctatttaaaaaaaaaaaaaaaaaaaaaagcccaacgcggatgctgagactgttgtcccagctactctggaggctgagacgggaggatcgcttgagctcaggagttctggtctgtcgtgcgctatgctgatatggtgtccacactaagttgggcatcaatatggtgacctcccggagacgggggccattaggttccctaaggaggggtgaacaagtccaggtctgaaaccaaacaggtcataactccagtgctgatcaatagcagaaccgttcctgggaatagccactgcacttcagcctgggcaacatagcgagactctgtctcttaaaaaaaaaaataaaaattaaatttaagcccggcgcggtggctcacgcctgtaatccaagtactttgggaggccgaggccgggggtcacttgaggtccggagttcgagaccagcctggtcaacatggcgaaacccccgtctctactaatacaaaaaaaattagttgggtgtgatatcgcacgcctgtaatccca

SEQ ID NO: 3147 - DNA, 56 bp, Artificial Sequence
  Synthetic oligonucleotide
cctacaggactgtgtgcagcgtgaacgggcccctggtggtgctggaccgggtcaag

SEQ ID NO: 3148 - DNA, 99 bp, Artificial Sequence
  Synthetic oligonucleotide
tttgcccagtatgcggagatcgtccacttcaccctcccagatgggactcagaggagcgggcaggtgcttgaggtggctggcaccaaggcgattgttcag

SEQ ID NO: 3149 - DNA, 94 bp, Artificial Sequence
  Synthetic oligonucleotide
gtgtttgaagggacatcagggatcgatgccaggaagaccacttgcgaatttacaggggacatcctacgaactccggtgtcagaggacatgctgg

SEQ ID NO: 3150 - DNA, 78 bp, Artificial Sequence
  Synthetic oligonucleotide
gtcgggttttcaatggctccggcaagcccattgacaaggggccagtggtcatggcggaggactttctggatatcaatg

SEQ ID NO: 3151 - DNA, 102 bp, Artificial Sequence
  Synthetic oligonucleotide
attgccgctcagatctgccgccaggcggggctggtgaagaagtccaaggctgtgctggattaccatgacgacaacttcgccatcgtctttgcagccatgggg

SEQ ID NO: 3152 - DNA, 21 bp, Artificial Sequence
  Synthetic oligonucleotide
gtgaggagacttagtagactg

SEQ ID NO: 3153 - DNA, 98 bp, Artificial Sequence
  Synthetic oligonucleotide
gtgaacatggagacagccagattcttcaagtctgactttgagcagaatggaaccatggggaacgtctgcctcttcctgaacttggccaatgaccccac

SEQ ID NO: 3154 - DNA, 24 bp, Artificial Sequence
  Synthetic oligonucleotide
atttccctaaacatttatttagaa

SEQ ID NO: 3155 - DNA, 24 bp, Artificial Sequence
  Synthetic oligonucleotide
gtctcgcggctagaaaggggtgct

SEQ ID NO: 3156 - DNA, 96 bp, Artificial Sequence
  Synthetic oligonucleotide
gtctctgctgctagagaggaggtgcctgggcgccgagggtttcctggatatatgtacacagacctggccaccatctacgagcgggcggccgtgtgg

SEQ ID NO: 3157 - DNA, 54 bp, Artificial Sequence
  Synthetic oligonucleotide
agggtcggggaggatccatcacacagatccccatcctcaccatgcccaacgacg

SEQ ID NO: 3158 - DNA, 83 bp, Artificial Sequence
  Synthetic oligonucleotide
atatcacccaccctatcccagacttgacgggcttcatcacagagggacagatctacgtggacagacagcttcacaacagacag

SEQ ID NO: 3159 - DNA, 42 bp, Artificial Sequence
  Synthetic oligonucleotide
gttaaaggtgacctctatgacgtttttctctttgcttggcag

SEQ ID NO: 3160 - DNA, 39 bp, Artificial Sequence
  Synthetic oligonucleotide
agtcctgctgtccaccactccctttttcttctccctcag

SEQ ID NO: 3161 - DNA, 105 bp, Artificial Sequence
  Synthetic oligonucleotide
atctacccccccatcaacgtgctcccttccctgtcgcggctgatgaagtcagccattggggaaggcatgacaagaaaggaccatggagatgtctccaaccagctg

SEQ ID NO: 3162 - DNA, 2719 bp, Homo sapiens
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttggtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacagggtcctgctctgtagcccaggctggagtgcaggggcacaatcatggctcactgcagcctcaaactcccaggcccctaagtagctgtgactacaggcgtgcaccattatgctcagctaatttttaaaatattttgtagagatggggtctcattacgttgcccaggctggtctcaaactcctgggctcaaacaatcctcctccctcagcctcccaaagtgctggaatcacaggcatgtgccaccacgcccggtcccactccccactttctattccccctttctgagacctctctccaccgatccctagggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3163 - DNA, 2007 bp, Homo sapiens
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3164 - DNA, 2328 bp, Homo sapiens
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaaggtgagtgccgtccggcccatggggggtggtgttgcagaagtgggacctgtgctggaggatcagactctaattctggaaccccttacctacttttcatccagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3165 - DNA, 2410 bp, Homo sapiens
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggtgagctggaggtcaccaggcgcaggagagagctggggtaggctccgcatgcctggcagtggcccatgtgggttgaatgtggagtgagcggctcaggtacctataacctgttgtgtcttccctctactccctaacatacactggcctctgggatcgccaacccctgctgctcttctcttgcaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3166 - DNA, 2387 bp, Homo sapiens
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggagggtgagtgtcgctgctggggaactggaactgcctgcggggcagttggagcgcccagacctggagctgctggaaagagtacccagcaagggagagcctgggacttggagctgctagagaagggtgctgggagcctcccgcttacgtatggaaagtgtctttgtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3167 - DNA, 2067 bp, Homo sapiens
tggagccagacttcgggccttccgggggagatacgagtcaggaaagggatctggtgctggggactcggagcttccggagtggggctgagagaggacccccaggtaaggggggaagctagtaggagaaggggtgctgcgaatggttgtggacagtgttaaggcagggtccagatgccgctgtgctggagaaggaatggggtgggggcatagggaaggagagaaacccaccaagacccctctttcatcccttgggagtccagagtccagtcctgtgcttcctttgcctggtaaccctctcccttccccaccggcctcaatccacctccccatccctcctgccctctccttcccacccacagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3168 - DNA, 1791 bp, Homo sapiens
tcagcttctggacgcgaggtgctggggggaggggtgctggtaatggacgctagggccctggagtacccagggaggagtcccagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3169 - DNA, 225 bp, Artificial Sequence
  Synthetic oligonucleotide
ggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggagg

SEQ ID NO: 3170 - DNA, 160 bp, Artificial Sequence
  Synthetic oligonucleotide
gtgagtgtcgctgctggggaactggaactgcctgcggggcagttggagcgcccagacctggagctgctggaaagagtacccagcaagggagagcctgggacttggagctgctagagaagggtgctgggagcctcccgcttacgtatggaaagtgtctttg

SEQ ID NO: 3171 - DNA, 359 bp, Artificial Sequence
  Synthetic oligonucleotide
tggagccagacttcgggccttccgggggagatacgagtcaggaaagggatctggtgctggggactcggagcttccggagtggggctgagagaggacccccaggtaaggggggaagctagtaggagaaggggtgctgcgaatggttgtggacagtgttaaggcagggtccagatgccgctgtgctggagaaggaatggggtgggggcatagggaaggagagaaacccaccaagacccctctttcatcccttgggagtccagagtccagtcctgtgcttcctttgcctggtaaccctctcccttccccaccggcctcaatccacctccccatccctcctgccctctccttcccacccacag

SEQ ID NO: 3172 - DNA, 169 bp, Artificial Sequence
  Synthetic oligonucleotide
tctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaatag

SEQ ID NO: 3173 - DNA, 145 bp, Artificial Sequence
  Synthetic oligonucleotide
gggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcat

SEQ ID NO: 3174 - DNA, 185 bp, Artificial Sequence
  Synthetic oligonucleotide
cacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccc

SEQ ID NO: 3175 - DNA, 156 bp, Artificial Sequence
  Synthetic oligonucleotide
gcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaag

SEQ ID NO: 3176 - DNA, 492 bp, Artificial Sequence
  Synthetic oligonucleotide
gtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacagggtcctgctctgtagcccaggctggagtgcaggggcacaatcatggctcactgcagcctcaaactcccaggcccctaagtagctgtgactacaggcgtgcaccattatgctcagctaatttttaaaatattttgtagagatggggtctcattacgttgcccaggctggtctcaaactcctgggctcaaacaatcctcctccctcagcctcccaaagtgctggaatcacaggcatgtgccaccacgcccggtcccactccccactttctattccccctttctgagacctctctccaccgatccctag

SEQ ID NO: 3177 - DNA, 155 bp, Artificial Sequence
  Synthetic oligonucleotide
ggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaag

SEQ ID NO: 3178 - DNA, 141 bp, Artificial Sequence
  Synthetic oligonucleotide
atcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatc

SEQ ID NO: 3179 - DNA, 176 bp, Artificial Sequence
  Synthetic oligonucleotide
gatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctc

SEQ ID NO: 3180 - DNA, 200 bp, Artificial Sequence
  Synthetic oligonucleotide
ctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtcccc

SEQ ID NO: 3181 - DNA, 78 bp, Artificial Sequence
  Synthetic oligonucleotide
agtggcgcgcaggcttttgtaacgttcccagcgccgcgtttgaattcggggaggagcggagcggtgcggaggctctgc

SEQ ID NO: 3182 - DNA, 95 bp, Artificial Sequence
  Synthetic oligonucleotide
tcggatcgaggtctgcagcgcagcttcgggagcatgagtgctgcagtgactgcagggaagctggcacgggcaccggccgaccctgggaaagccgg

SEQ ID NO: 3183 - DNA, 26 bp, Artificial Sequence
  Synthetic oligonucleotide
ggtccccggagttgcagctcccggag

SEQ ID NO: 3184 - DNA, 95 bp, Artificial Sequence
  Synthetic oligonucleotide
ctccggcggcggctccaccggcgaaagagatcccggaggtcctagtggacccacgcagccggcggcgctatgtgcggggccgctttttgggcaag

SEQ ID NO: 3185 - DNA, 83 bp, Artificial Sequence
  Synthetic oligonucleotide
tcagcttctggacgcgaggtgctggggggaggggtgctggtaatggacgctagggccctggagtacccagggaggagtcccag

SEQ ID NO: 3186 - DNA, 94 bp, Artificial Sequence
  Synthetic oligonucleotide
gtataccttgttagtgggcaaaccaccttttgagacttcttgcctaaaagagacctacctccggatcaagaagaatgaatacagtattcccaag

SEQ ID NO: 3187 - DNA, 35 bp, Artificial Sequence
  Synthetic oligonucleotide
cagcaaccggaagcccctcacagtcctcaataaag

SEQ ID NO: 3188 - DNA, 28 bp, Artificial Sequence
  Synthetic oligonucleotide
aggaggctgaggatcctgcctgcatccc

SEQ ID NO: 3189 - DNA, 50 bp, Artificial Sequence
  Synthetic oligonucleotide
catcttctgggtcagcaagtgggtggactattcggacaagtacggccttg

SEQ ID NO: 3190 - DNA, 101 bp, Artificial Sequence
  Synthetic oligonucleotide
gtgagtgccgtccggcccatggggggtggtgttgcagaagtgggacctgtgctggaggatcagactctaattctggaaccccttacctacttttcatccag

SEQ ID NO: 3191 - DNA, 42 bp, Artificial Sequence
  Synthetic oligonucleotide
ctgcacctcagcaacggcagcgtgcagatcaacttcttccag

SEQ ID NO: 3192 - DNA, 96 bp, Artificial Sequence
  Synthetic oligonucleotide
gtgagctggaggtcaccaggcgcaggagagagctggggtaggctccgcatgcctggcagtggcccatgtgggttgaatgtggagtgagcggctcag

SEQ ID NO: 3193 - DNA, 87 bp, Artificial Sequence
  Synthetic oligonucleotide
gtacctataacctgttgtgtcttccctctactccctaacatacactggcctctgggatcgccaacccctgctgctcttctcttgcag

SEQ ID NO: 3194 - DNA, 31 bp, Artificial Sequence
  Synthetic oligonucleotide
ggccagcaaccgtctcaaggcctcctaatag

SEQ ID NO: 3195 - DNA, 101 bp, Artificial Sequence
  Synthetic oligonucleotide
ctccccctcaaccccaccatatgaattgtacagaatatttctattgaattcggaactgtcctttccttggctttatgcacattaaacagatgtgaatattc

SEQ ID NO: 3196 - DNA, 2516 bp, Homo sapiens
gaaaagccatttccgactccagactggtccccgctccccgcaagcccccccccccgctcccacggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3197 - DNA, 2956 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcggggtgagtctctctagcccctgccccgccatggggagacgcccactcccaggtccctggcacccacccaggaggtgttaaagctggggtggtgtgtgggccttggctccagtggtcctgggaaccccaggggcacatgctgtgcttaggtcccatcccctgtgtctacctcttgggctggggaccgctgggctcctgccgccccccgccccggcccatcctgcctcctttctagcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3198 - DNA, 3206 bp, Homo sapiens
agctcaaattattgtcatgaaggtggaggagggagggtgttctgatggcagggagtgtagggggcccctggagtctggtactttctgttccttaacctaggagaagggtccatggtgccgatttatcacagtgttttttttttcttgggggtagttttaccaccaggagacgtctgtggttgtcacaactgggggtgcccctggcatggagtgggtggaggccagggatgctgctcggctccttgtagtgcctggaacagccccgccccagagaacaatccagccccagatgtctttggttcttcgatgctccaaaggagagactgtgatttgtaatatatatatattttttcttgagacggagtctcgctctgtcacccaggctggaatgcattggcacgatctcggctcactgcaacctccacctcccgggttcaagcgattctcctgcctcagcctcctgagtagctgggaatacaggtgtttcaccatgttggccaggctggtctcgaactcctggcctcaggtgatctgcccacctcagccttccaaagcgctgggattccaggcgtgagccaccatgcccggcctgatttgtaactattctacctgcacttaggtttggtttctttctccgtgtgcttatttcaaaattccaaaaggaaagggagagagtgagagggaaaaagataaaagagaaatgggaagtaccggggcaaagatgagagggtggcggggagaggtcaggtccccaagggcaccgctagcatgagcaggggctcaatgtaccctctacctgatcccttccacccgccagcatcagcagcaggtgctccaggccgtagaacgcgccaagcaggtcaccgtgggggagctgaacagcctcatcggggtgagtctctctagcccctgccccgccatggggagacgcccactcccaggtccctggcacccacccaggaggtgttaaagctggggtggtgtgtgggccttggctccagtggtcctgggaaccccaggggcacatgctgtgcttaggtcccatcccctgtgtctacctcttgggctggggaccgctgggctcctgccgccccccgccccggcccatcctgcctcctttctagcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3199 - DNA, 2936 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcggggtgagtctctctagcccctgccccgccatggggagacgcccactcccaggtccctggcacccacccaggaggtgttaaagctggggtggtgtgtgggccttggctccagtggtcctgggaaccccaggggcacatgctgtgcttaggtcccatcccctgtgtctacctcttgggctggggaccgctgggctcctgccgccccccgccccggcccatcctgcctcctttctagcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3200 - DNA, 2774 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcggctggagtgcaatggcaccatctcagctcactgcaacctcccgctcccagccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3201 - DNA, 1996 bp, Homo sapiens
gggctttataaactggagggctgtaccctctggcgccgtggatacaaacgcctcattctttctccttctttctctttatcccattcccaatctgtcagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3202 - DNA, 1198 bp, Homo sapiens
tgcaagacaatcaggacagggtttgcaggccaaccatgggtggggcttataggtaaaggatggagcttatagtcagatggggcagtgtttgcaggtcaaaggggcggggctcaccagccaatcagggtagggcttgcaggctaatcaggatgaggctacattgggctccagagacccccacgttgagctaggctcctagagacctcacctgggaccaacccccagcccctgcttctctccccgaccccagaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3203 - DNA, 1597 bp, Homo sapiens
agcctgcctcggcctcccgagtggctgggattacaggtgcctgcagccacgcccggctaatttttgcatttttggtggagatgggttttcgccgtgttggccaggctggtcatgaacttctgacctcggatgatccgcccgcctcggcctcccacagtgttgggattacaggcctgagccacagagcccggccaaggcctggtctttcatagtcttgctctgtgaccttgaggggacactgcctcagcttccatcatctgcttaaggggagtgattgtccttgcctggctgttcccttctctgtccctcctccctcctctctccctcctccctgtgctgttgtgcgctcagagcagataatggatgtgcagccctagggttctgtgtaattctgattaatattaatgattcgacatgcagttgtctgctgtgttcccagtcctgggccagctgcctttctctaggggggtgctgaagagggagaatgttggactccacccccgcaacccctgatggtgctgggcaccccccaatatccaaaggggctcgtaggctgacatggtggctcacacctgtggtcccagcactttgggaggccgaggcgggcagatcacttgaggttggcagtttgagaccagcctggccaatacggtgaaacgccgtctttactaaagatacaaaaattacccgggcgtactagcaggtacctgtaatcccagctactttggaggctgaggcaggagaatcccttgaacctgggaggcagaggctgcagtgagctgagactgcaacattgcactccagcctgggtgacacagtgagactctgtctcaaaaaaaaaaaaagattatccagcgtgatggtgcatgcctgtagtctcagcttctggtgctgaggcaggaggatctcttgagccctggaggtcaaggctgcagtgagccatgattgtgccactgcactccagcctgggtgacggagtgagaccctgtctcaacacaaaacaaagaggggctcgtgaccccatctcttccctctttacccccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3204 - DNA, 1280 bp, Homo sapiens
tgatctcagctccctgcaacctgcgcctcccaggttcaaatgattcttgtgcctcagccacctgagtagctgggactacaggaacgcaccaccatgctcggctaatttttgtatttgtcggtagagacggggtttcactgtgttgtccaggttggtcttggattcctggcctcaagtgatccacctgcctcggcttcccagtgtgggaattacaggcctgagccaccgcgcttgccctcccaagctctttatgtccaacctgctcttctctttcaggagtgcaggtggacacagctctccatcccgtggccccgaagcttaggtgggctaagaacatttctagggatcccatggtgaatatctcctagctcactgggtgtcccccaatgcgtctttacacagaaacacttctgtatggccaggagaggacatttgaagccctccagtcttctcttctgcaaatgtgtggttatttccacaggcatcttgttagtgagactccaagaggtttggggtggaacagagcctgattcctgtttgtgcttaaaatgaggtggaggaccctgaatcttttaaaaatcaaaccgaggccgggtgcagtggctcacgcctgtaatctcagcactttgggaggccgaggtgggtggatcacttgaggtcaggagttcgagaccagcctgaccaacatggagaaactccatctctaccaaaaatacaaaattagccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgcaaaaaaa

SEQ ID NO: 3205 - DNA, 1338 bp, Homo sapiens
tgcaagacaatcaggacagggtttgcaggccaaccatgggtggggcttataggtaaaggatggagcttatagtcagatggggcagtgtttgcaggtcaaaggggcggggctcaccagccaatcagggtagggcttgcaggctaatcaggatgaggctacattgggctccagagacccccacgttgagctaggctcctagagacctcacctgggaccaacccccagcccctgcttctctccccgaccccagaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccaggtgctgttcggttctggcaggagggggatggaagctctaggaatacagcatcccttcctctccttgtgaggtgcccacttccagaggcaggacaggacaggactcccatctgctgtggtgtccatctttcttgtcccccagacacatccacaggcttcccctgtaactctctaaagatgtaggggaacacaaaagagctgattcataggaagctgtggggctactgagacccccagatcatcttccccacctgcttttgtccagccatacccttatatgtgcctttcctcgtgtagctgggtggttcttctagcctttaatctctggacgccgccgagagcgcgggacacacacttcccaactgaggactaaccatgggggagctactggccaggaggacagagtggaggttgatgtaggaggagctgggcatggagagatccccattgaaggtggagtctaagctgaaggacatggtgaacaggctggacagagctgggggctcctcagggctgggcaaagagagtgaatcttcaggcaccgtgaccccagatcctgcctctcactgctttgggggcagctgtgagctccttcttctgtcattcagggtttccatgggctggtctcatgcacaccatactccgggacagctctgaggcctctgcacatttgttccctgtggctgaaatgcc

SEQ ID NO: 3206 - DNA, 272 bp, Artificial Sequence
  Synthetic oligonucleotide
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcag

SEQ ID NO: 3207 - DNA, 740 bp, Artificial Sequence
  Synthetic oligonucleotide
gtactttctgttccttaacctaggagaagggtccatggtgccgatttatcacagtgttttttttttcttgggggtagttttaccaccaggagacgtctgtggttgtcacaactgggggtgcccctggcatggagtgggtggaggccagggatgctgctcggctccttgtagtgcctggaacagccccgccccagagaacaatccagccccagatgtctttggttcttcgatgctccaaaggagagactgtgatttgtaatatatatatattttttcttgagacggagtctcgctctgtcacccaggctggaatgcattggcacgatctcggctcactgcaacctccacctcccgggttcaagcgattctcctgcctcagcctcctgagtagctgggaatacaggtgtttcaccatgttggccaggctggtctcgaactcctggcctcaggtgatctgcccacctcagccttccaaagcgctgggattccaggcgtgagccaccatgcccggcctgatttgtaactattctacctgcacttaggtttggtttctttctccgtgtgcttatttcaaaattccaaaaggaaagggagagagtgagagggaaaaagataaaagagaaatgggaagtaccggggcaaagatgagagggtggcggggagaggtcaggtccccaagggcaccgctagcatgagcaggggctcaatgtaccctctacctgatcccttccacccgccag

SEQ ID NO: 3208 - DNA, 232 bp, Artificial Sequence
  Synthetic oligonucleotide
gtgagtctctctagcccctgccccgccatggggagacgcccactcccaggtccctggcacccacccaggaggtgttaaagctggggtggtgtgtgggccttggctccagtggtcctgggaaccccaggggcacatgctgtgcttaggtcccatcccctgtgtctacctcttgggctggggaccgctgggctcctgccgccccccgccccggcccatcctgcctcctttctag

SEQ ID NO: 3209 - DNA, 128 bp, Artificial Sequence
  Synthetic oligonucleotide
cccagccgggctggtgggcggcagtgctacggggctgcttgctctgtctggagccctggctgcccaggctcagctggcggcggctgtcaaggaggaccgtgcgggcgtggaggccgaggggtccagag

SEQ ID NO: 3210 - DNA, 125 bp, Artificial Sequence
  Synthetic oligonucleotide
ccctgaggagccccctgactctgtccagtcccttcaccacgtccttcagcctgggctcccacagcactctcaacggagacctctccgtgcccagctcctacgtcagcctccacctgtccccccag

SEQ ID NO: 3211 - DNA, 139 bp, Artificial Sequence
  Synthetic oligonucleotide
ctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaag

SEQ ID NO: 3212 - DNA, 250 bp, Artificial Sequence
  Synthetic oligonucleotide
tgcaagacaatcaggacagggtttgcaggccaaccatgggtggggcttataggtaaaggatggagcttatagtcagatggggcagtgtttgcaggtcaaaggggcggggctcaccagccaatcagggtagggcttgcaggctaatcaggatgaggctacattgggctccagagacccccacgttgagctaggctcctagagacctcacctgggaccaacccccagcccctgcttctctccccgaccccag

SEQ ID NO: 3213 - DNA, 692 bp, Artificial Sequence
  Synthetic oligonucleotide
gtgctgttcggttctggcaggagggggatggaagctctaggaatacagcatcccttcctctccttgtgaggtgcccacttccagaggcaggacaggacaggactcccatctgctgtggtgtccatctttcttgtcccccagacacatccacaggcttcccctgtaactctctaaagatgtaggggaacacaaaagagctgattcataggaagctgtggggctactgagacccccagatcatcttccccacctgcttttgtccagccatacccttatatgtgcctttcctcgtgtagctgggtggttcttctagcctttaatctctggacgccgccgagagcgcgggacacacacttcccaactgaggactaaccatgggggagctactggccaggaggacagagtggaggttgatgtaggaggagctgggcatggagagatccccattgaaggtggagtctaagctgaaggacatggtgaacaggctggacagagctgggggctcctcagggctgggcaaagagagtgaatcttcaggcaccgtgaccccagatcctgcctctcactgctttgggggcagctgtgagctccttcttctgtcattcagggtttccatgggctggtctcatgcacaccatactccgggacagctctgaggcctctgcacatttgttccctgtggctgaaatgcc

SEQ ID NO: 3214 - DNA, 728 bp, Artificial Sequence
  Synthetic oligonucleotide
tgatctcagctccctgcaacctgcgcctcccaggttcaaatgattcttgtgcctcagccacctgagtagctgggactacaggaacgcaccaccatgctcggctaatttttgtatttgtcggtagagacggggtttcactgtgttgtccaggttggtcttggattcctggcctcaagtgatccacctgcctcggcttcccagtgtgggaattacaggcctgagccaccgcgcttgccctcccaagctctttatgtccaacctgctcttctctttcaggagtgcaggtggacacagctctccatcccgtggccccgaagcttaggtgggctaagaacatttctagggatcccatggtgaatatctcctagctcactgggtgtcccccaatgcgtctttacacagaaacacttctgtatggccaggagaggacatttgaagccctccagtcttctcttctgcaaatgtgtggttatttccacaggcatcttgttagtgagactccaagaggtttggggtggaacagagcctgattcctgtttgtgcttaaaatgaggtggaggaccctgaatcttttaaaaatcaaaccgaggccgggtgcagtggctcacgcctgtaatctcagcactttgggaggccgaggtgggtggatcacttgaggtcaggagttcgagaccagcctgaccaacatggagaaactccatctctaccaaaaatacaaaattagccag

SEQ ID NO: 3215 - DNA, 1045 bp, Artificial Sequence
  Synthetic oligonucleotide
agcctgcctcggcctcccgagtggctgggattacaggtgcctgcagccacgcccggctaatttttgcatttttggtggagatgggttttcgccgtgttggccaggctggtcatgaacttctgacctcggatgatccgcccgcctcggcctcccacagtgttgggattacaggcctgagccacagagcccggccaaggcctggtctttcatagtcttgctctgtgaccttgaggggacactgcctcagcttccatcatctgcttaaggggagtgattgtccttgcctggctgttcccttctctgtccctcctccctcctctctccctcctccctgtgctgttgtgcgctcagagcagataatggatgtgcagccctagggttctgtgtaattctgattaatattaatgattcgacatgcagttgtctgctgtgttcccagtcctgggccagctgcctttctctaggggggtgctgaagagggagaatgttggactccacccccgcaacccctgatggtgctgggcaccccccaatatccaaaggggctcgtaggctgacatggtggctcacacctgtggtcccagcactttgggaggccgaggcgggcagatcacttgaggttggcagtttgagaccagcctggccaatacggtgaaacgccgtctttactaaagatacaaaaattacccgggcgtactagcaggtacctgtaatcccagctactttggaggctgaggcaggagaatcccttgaacctgggaggcagaggctgcagtgagctgagactgcaacattgcactccagcctgggtgacacagtgagactctgtctcaaaaaaaaaaaaagattatccagcgtgatggtgcatgcctgtagtctcagcttctggtgctgaggcaggaggatctcttgagccctggaggtcaaggctgcagtgagccatgattgtgccactgcactccagcctgggtgacggagtgagaccctgtctcaacacaaaacaaagaggggctcgtgaccccatctcttccctctttacccccag

SEQ ID NO: 3216 - DNA, 121 bp, Artificial Sequence
  Synthetic oligonucleotide
gactggctggcggtcggaatggagagtagcaacgtggagatcctgcacgtccgcaagccggagaaataccagctgcacctccacgagagctgcgtgctgtccctgaagtttgcctcctgcg

SEQ ID NO: 3217 - DNA, 193 bp, Artificial Sequence
  Synthetic oligonucleotide
tccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccag

SEQ ID NO: 3218 - DNA, 64 bp, Artificial Sequence
  Synthetic oligonucleotide
gaaaagccatttccgactccagactggtccccgctccccgcaagcccccccccccgctcccacg

SEQ ID NO: 3219 - DNA, 25 bp, Artificial Sequence
  Synthetic oligonucleotide
gatgtacccccagggaaggcacccg

SEQ ID NO: 3220 - DNA, 98 bp, Artificial Sequence
  Synthetic oligonucleotide
accccgctccagtccggccagcccttcaagttctcgatcttggagatctgcgaccgcatcaaagaagaattccagtttcttcaggctcaataccacag

SEQ ID NO: 3221 - DNA, 64 bp, Artificial Sequence
  Synthetic oligonucleotide
cctcaagctagaatgtgagaagctggccagcgagaagacggaaatgcagcgacattatgtcatg

SEQ ID NO: 3222 - DNA, 45 bp, Artificial Sequence
  Synthetic oligonucleotide
tattatgagatgtcgtacgggctcaacattgaaatgcataagcag

SEQ ID NO: 3223 - DNA, 63 bp, Artificial Sequence
  Synthetic oligonucleotide
gcggagattgtgaagcgtctgagcggtatctgcgctcagattatccccttcctgacccaggag

SEQ ID NO: 3224 - DNA, 77 bp, Artificial Sequence
  Synthetic oligonucleotide
agctcaaattattgtcatgaaggtggaggagggagggtgttctgatggcagggagtgtagggggcccctggagtctg

SEQ ID NO: 3225 - DNA, 75 bp, Artificial Sequence
  Synthetic oligonucleotide
catcagcagcaggtgctccaggccgtagaacgcgccaagcaggtcaccgtgggggagctgaacagcctcatcggg

SEQ ID NO: 3226 - DNA, 56 bp, Artificial Sequence
  Synthetic oligonucleotide
cagcagcagctccagccgctgtcccaccacgcaccccctgtgcccctcaccccccg

SEQ ID NO: 3227 - DNA, 98 bp, Artificial Sequence
  Synthetic oligonucleotide
gggctttataaactggagggctgtaccctctggcgccgtggatacaaacgcctcattctttctccttctttctctttatcccattcccaatctgtcag

SEQ ID NO: 3228 - DNA, 20 bp, Artificial Sequence
  Synthetic oligonucleotide
tggagagagccccgagcagg

SEQ ID NO: 3229 - DNA, 103 bp, Artificial Sequence
  Synthetic oligonucleotide
agtgcatctccctcgccccctgagagtctcgtggaggaggagcgaccgagtggccctggtggtggcgggaagcagagagcagatgagaaggagccatcaggac

SEQ ID NO: 3230 - DNA, 5 bp, Artificial Sequence
  Synthetic oligonucleotide
cttat

SEQ ID NO: 3231 - DNA, 45 bp, Artificial Sequence
  Synthetic oligonucleotide
gaaagcgacgaagacaagagtgattacaatctggtggtggacgag

SEQ ID NO: 3232 - DNA, 48 bp, Artificial Sequence
  Synthetic oligonucleotide
gaccaaccctcagagccccccagcccggctaccaccccctgcggaaag

SEQ ID NO: 3233 - DNA, 102 bp, Artificial Sequence
  Synthetic oligonucleotide
gtacccatctgcattcctgcccgtcgggacctggtggacagtccagcctccttggcctctagccttggctcaccgctgcctagagccaaggagctcatcctg

SEQ ID NO: 3234 - DNA, 17 bp, Artificial Sequence
  Synthetic oligonucleotide
aatgaccttcccgccag

SEQ ID NO: 3235 - DNA, 63 bp, Artificial Sequence
  Synthetic oligonucleotide
cactcctgcctccaaatcctgtgactcctccccgccccaggacgcttccacccccgggcccag

SEQ ID NO: 3236 - DNA, 59 bp, Artificial Sequence
  Synthetic oligonucleotide
ctcggccagtcacctctgccagcttgctgccaagccagcaccttccacggacagcgtcg

SEQ ID NO: 3237 - DNA, 50 bp, Artificial Sequence
  Synthetic oligonucleotide
gctggagtgcaatggcaccatctcagctcactgcaacctcccgctcccag

SEQ ID NO: 3238 - DNA, 36 bp, Artificial Sequence
  Synthetic oligonucleotide
gtcagcagctctgtggtgtacggacgctcccccgtg

SEQ ID NO: 3239 - DNA, 77 bp, Artificial Sequence
  Synthetic oligonucleotide
atggcatttgagtctcatccccatctccgagggtcatccgtctcttcctccctacccagcatccctgggggaaagcc

SEQ ID NO: 3240 - DNA, 54 bp, Artificial Sequence
  Synthetic oligonucleotide
ggcctactccttccacgtgtctgcggacgggcagatgcagccggttcccttccc

SEQ ID NO: 3241 - DNA, 26 bp, Artificial Sequence
  Synthetic oligonucleotide
gtgtgggacgtgggccagcctggggc

SEQ ID NO: 3242 - DNA, 31 bp, Artificial Sequence
  Synthetic oligonucleotide
caagacgcccgtggcccagctcgactgcctg

SEQ ID NO: 3243 - DNA, 107 bp, Artificial Sequence
  Synthetic oligonucleotide
aaccgagacaactacattcgttcctgcaagttgctgccggatggccggagtctgatcgtgggcggtgaggccagcaccttgtccatttgggacctggcggcgcccac

SEQ ID NO: 3244 - DNA, 39 bp, Artificial Sequence
  Synthetic oligonucleotide
cccccgtatcaaggccgagctgacttcctcagccccagc

SEQ ID NO: 3245 - DNA, 34 bp, Artificial Sequence
  Synthetic oligonucleotide
ctgctacgccctggccgtcagccccgacgccaag

SEQ ID NO: 3246 - DNA, 68 bp, Artificial Sequence
  Synthetic oligonucleotide
gtttgcttctcctgctgcagcgatggcaacattgtggtctgggacctgcagaatcagactatggtcag

SEQ ID NO: 3247 - DNA, 30 bp, Artificial Sequence
  Synthetic oligonucleotide
gcagttccagggccacacggacggcgccag

SEQ ID NO: 3248 - DNA, 27 bp, Artificial Sequence
  Synthetic oligonucleotide
ctgcattgatatttccgattacggcac

SEQ ID NO: 3249 - DNA, 64 bp, Artificial Sequence
  Synthetic oligonucleotide
tcggctctggacagggggcctggacaacacggtgcgctgctgggacctgcgggagggccgccag

SEQ ID NO: 3250 - DNA, 27 bp, Artificial Sequence
  Synthetic oligonucleotide
ctgcagcagcatgacttcagctcccag

SEQ ID NO: 3251 - DNA, 30 bp, Artificial Sequence
  Synthetic oligonucleotide
attttctccctgggccactgccctaaccag

SEQ ID NO: 3252 - DNA, 77 bp, Artificial Sequence
  Synthetic oligonucleotide
gacggtggtttgtgagcaccgggaaggacaacctgctcaacgcctggaggacgccgtacggggccagcattttccag

SEQ ID NO: 3253 - DNA, 36 bp, Artificial Sequence
  Synthetic oligonucleotide
ccctgcctaggaaccgtacatcccatctgctctctg

SEQ ID NO: 3254 - DNA, 95 bp, Artificial Sequence
  Synthetic oligonucleotide
gccaacggcttcacaccttcccctgctgcatgtgggggccgatgggcaggggacctcggtggaaataaaatgtatctatcacatccgcaaaaaaa

SEQ ID NO: 3255 - DNA, 4997 bp, Homo sapiens
catcacctccaggccagcctgccacctgcctctgacttccacagctctgagacccccagggccaatagccctccctcctcactggaaagctgcacttaacaggagcttgtgccagtgactcaaaatagaaatgttttgtgggagatgttgactggtgtcactgcggggtttcacgtgacggcgctgcatctgctgtcccagcctactgtctctgtgggatgtttgtttcctaatttgtggtgggttctcttccttgcccttttgtgtgccctcattgcccccgccctgatttcccatctctccatgttatctccagactgttgtgggctagcctgggaactgccccacccttcactgcactgtacttcggggaacgtgctgtccaggaatggagaggatggtcacagctgcacctctctccctcactcaggggacatttcctaaggaagggccttattgcaaggtgggcccatggctgccttgctcactgccatatccctgcgctgagaacagtgcctggcctgtcagtaaagacttgtccagtgaatgaacatccacaggcagggccaggcctggtctgagaatttgcaccttggagggtgcagctcgcaggccatcacaagggctcttctgtagtgcagtgcaatccctgagatcaggagtcggctgcttccggcctccacagcttccacggggccagctgccctccctcctcactgtaaagctacacttgaccctgcaatagaggcttgtgccagtgaccccagacaaaactgttgtgtgggggatgctgactggtgtcactgtggggcttcatgcgagggtgccggtgtctgacactaagttggtctgtgttgaggggggatgtgtgtactcagggctggagcggatggggggacagtttcttaccccacaaatgcaccacctttgaggggctcaattcccatcatagacatggaagatttatatatttatattgacaaaattccagcagaaggcaatcgagggtctcattctaggaaaggtccatctattatggaactggtcagtctcgtgatgagaaagtgacttgttttgatttgcacaggggtgccctgtaagcttgtcatggagctgcgcctacctgtgtgggtctgtgtggaaaaggctttctctccccaggagaatggtgctaggtctacctgttgaaggctctgggtctgttgtagaaggccaagtgccccccatggttggctgactgtatggccgagtgtacccccaatgagtgcctgtggatgactatctctctgtggatggcaagtgtctggccgtggatggccaactgttcagccatgggggaccaggtgttccccagtggatgggtgtcccctcctccgtggctgggtgtccaccgtggggggtcaggtattccccgtgaatggccatctgttggctcttggagaacagtgcattttcctgggaacacagccatggcccctccaccgccctctgccacttggcccatcatcagcagatctggaggtgatgggggcctggcctggcttccccagtccctgcagcttctctgcaaggctctgaggtgtggagcccatagggtgtgttgcgggggaaccggggcacagcaggaggcccccaggtggctctaggggttacatcccctcccttcccctgccaggctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatgtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttagcctcagagacgaatcgacaccctcaactcagatggatacacccctgagccaggtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcattgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattcttttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtgggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgtc

SEQ ID NO: 3256 - DNA, 4400 bp, Homo sapiens
tcggctcgagctgaaaccctgcctttgcttagcctcattcccatctctcagtcccatcctgcagctgggcaggcagtgctgggccccggaaatgccctctgcctccctggagcacgtggcctgtgattttccttgagcacagcactttgtgactttgatgtaaacatcaaacacagccccctttcctgtcttcgcatccaggaaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccagatatgggcacctggcaggcgcctggttcctgactgttggcgagaggctgggaaatgtgtcccaggtaggaagcatccccgacaggaaggaacaggagttcatgaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatgtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttagcctcagagacgaatcgacaccctcaactcagatggatacacccctgagccaggtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcattgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattcttttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtgggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgtc

SEQ ID NO: 3257 - DNA, 6226 bp, Homo sapiens
tcggctcgagctgaaaccctgcctttgcttagcctcattcccatctctcagtcccatcctgcagctgggcaggcagtgctgggccccggaaatgccctctgcctccctggagcacgtggcctgtgattttccttgagcacagcactttgtgactttgatgtaaacatcaaacacagccccctttcctgtcttcgcatccaggaaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatgtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttagcctcagagacgaatcgacaccctcaactcagatggatacacccctgagccaggtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcattgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattcttttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtgggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgagtgccagtggggaggggacccggctgggctgacccctggaaagtcctggtgcccgatgagttgatgtcaatataactctacccaatgtaatctcacccaaagcccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacactccagtccccaccagccagcacacagcacccaactaccagacaggtgagcactgaggtaccaaatactcatctattccagcccccacctctgcctggttgaagcccaaccttcagacatctcaactcctaacaccatcagtatcccaacttcccatcagacaacaggcaacacacccccagacaagcggacgccctagactgcccatgcaatgtgtggacactgtaacgcatgaccccccaccggccagcacttagcatgctgacaccccaacacccaagcagcccaacagatagacaccctctctggctggcccaccctcctgcgacatgtgttaattccacctccatcaggaaacacccagggcaccacaccccagtacccaaagaggctagcacctagcaccccaacacagtccatggataccccatgcacagtaccgttaatactgccgctccccgctggccagacccactgccatgctccaggcttctgctgatcaccagccttgcactccctctcatctaagccccagcacactgataccctggccccaggtgcatgcacagagcatcagctttctatatcccaggtccccgtggtcaatagttgccactctgacaccaagtccactcagtcccctgagtcctcactggtcaacgctcggtagaggggtcatcccagcaccctgtgtgtgggcagctctgcctccttaggctgtgtggcattgcccaacgctctcacaccccagagtcctctccaccacccaatgtcccgccaccccaacagccctgctgactttctgagccccaaaagtctacctcagccaagcacagtgcatgcccacccactggtgaagctgggtcctgggggcgtggtcagcagcctggatgtaccccacgccccacaggtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgtctgagcgccctcatcttttccggggtgagggtaggtgtcaggggaggggtgggttatgaaaagtgcatggaggtgactgttcttgtgtggactgagcctggaagtgacccctgggaagatggggctgggtcccactctccaccctagggacaccttcatgtgagtgagcggctggggtggagtggggaacctgaggccaggcgggtgtgggcccaagggctgcgtgcctggctgagcccagctcccctgtgtggagatgagtgtgccccatgccaggtgcacgttaggatcacctggagctattttaacaaacgctaaccccccctcccccatccagctggggtcttcacccccccaggggtgccttgcaaatcatgagatacaatgcttttcattggtagatgcacgtattagctcccgtatgaaccgtattactgaatttgaatctgaaaaataccaaaatgcaaacattgtttttaaattaattgttttaaaagctaatgaacgaattaagacaaattgcatcaatttagtggtttcttaaatcgtggtttgcaggtagttcagttttattaaaattcatttgtgagtcgctgaacgacttacattatgtaaaatatatcagacagtaaatgaattgtggctttcattgccttttggtcatc

SEQ ID NO: 3258 - DNA, 3891 bp, Homo sapiens
tcggctcgagctgaaaccctgcctttgcttagcctcattcccatctctcagtcccatcctgcagctgggcaggcagtgctgggccccggaaatgccctctgcctccctggagcacgtggcctgtgattttccttgagcacagcactttgtgactttgatgtaaacatcaaacacagccccctttcctgtcttcgcatccaggaaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatgtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttagcctcagagacgaatcgacaccctcaactcagatggatacacccctgagccaggtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcattgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattcttttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtgggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagaggtgagcaccgggtgggcccggccatcgggtgggtggggccggggcccatcctgggcatggtggacatgcacccgcgtgcatgcgtgtgtgggaagccggggcacttccacaccatcgtggacacactctcagcctgcacacccacacccatacccatgcctgcaaagcagagctaaccctcagtccaccattgcaccagtgcggtaataacagtgtctacctccagggcctttgcgaggatcgaatgagtcggcacctataaagggcactgctagggccgggtgcggtggctcatgcctgtaattccagcactttgggaggccaaggcgggtggatcatgaggtcaagagatccagaccatcctggccaacatggtgaaaccccgtccttactaaaaatacaaaagattagctgggcgtggtggtgggcgcctcccagctactcaggaggctgaggcaggagaatcgcttgaacccacgaggcggagcttgcagtgagccgagattgtgccactgcactccagcctgggga

SEQ ID NO: 3259 - DNA, 2929 bp, Homo sapiens
acagctggcacagtggtatgaggacaatgactcattctgggtaaacgtcaagagacgaagcagctacaaagagccaggctcctggaaaattaggcaaggctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattcttttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtgggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgtctgagcgccctcatcttttccggggtgagggtaggtgtcaggggaggggtgggttatgaaaagtgcatggaggtgactgttcttgtgtggactgagcctggaagtgacccctgggaagatggggctgggtcccactctccaccctagggacaccttcatgtgagtgagcggctggggtggagtggggaacctgaggccaggcgggtgtgggcccaagggctgcgtgcctggctgagcccagctcccctgtgtggagatgagtgtgccccatgccaggtgcacgttaggatcacctggagctattttaacaaacgctaaccccccctcccccatccagctggggtcttcacccccccaggggtgccttgcaaatcatgagatacaatgcttttcattggtagatgcacgtattagctcccgtatgaaccgtattactgaatttgaatctgaaaaataccaaaatgcaaacattgtttttaaattaattgttttaaaagctaatgaacgaattaagacaaattgcatcaatttagtggtttcttaaatcgtggtttgcaggtagttcagttttattaaaattcatttgtgagtcgctgaacgacttacattatgtaaaatatatcagacagtaaatgaattgtggctttcattgccttttggtcatc

SEQ ID NO: 3260 - DNA, 310 bp, Artificial Sequence
  Synthetic oligonucleotide
tcggctcgagctgaaaccctgcctttgcttagcctcattcccatctctcagtcccatcctgcagctgggcaggcagtgctgggccccggaaatgccctctgcctccctggagcacgtggcctgtgattttccttgagcacagcactttgtgactttgatgtaaacatcaaacacagccccctttcctgtcttcgcatccaggaaataggttagtttcagacaagcctgcttgccggagctcagcagacaccaggccttccgggcaggcctggcccaccgtgggcctcagagctgctgctggggcattcag

SEQ ID NO: 3261 - DNA, 423 bp, Artificial Sequence
  Synthetic oligonucleotide
gtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggag

SEQ ID NO: 3262 - DNA, 151 bp, Artificial Sequence
  Synthetic oligonucleotide
ggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacg

SEQ ID NO: 3263 - DNA, 1675 bp, Artificial Sequence
  Synthetic oligonucleotide
catcacctccaggccagcctgccacctgcctctgacttccacagctctgagacccccagggccaatagccctccctcctcactggaaagctgcacttaacaggagcttgtgccagtgactcaaaatagaaatgttttgtgggagatgttgactggtgtcactgcggggtttcacgtgacggcgctgcatctgctgtcccagcctactgtctctgtgggatgtttgtttcctaatttgtggtgggttctcttccttgcccttttgtgtgccctcattgcccccgccctgatttcccatctctccatgttatctccagactgttgtgggctagcctgggaactgccccacccttcactgcactgtacttcggggaacgtgctgtccaggaatggagaggatggtcacagctgcacctctctccctcactcaggggacatttcctaaggaagggccttattgcaaggtgggcccatggctgccttgctcactgccatatccctgcgctgagaacagtgcctggcctgtcagtaaagacttgtccagtgaatgaacatccacaggcagggccaggcctggtctgagaatttgcaccttggagggtgcagctcgcaggccatcacaagggctcttctgtagtgcagtgcaatccctgagatcaggagtcggctgcttccggcctccacagcttccacggggccagctgccctccctcctcactgtaaagctacacttgaccctgcaatagaggcttgtgccagtgaccccagacaaaactgttgtgtgggggatgctgactggtgtcactgtggggcttcatgcgagggtgccggtgtctgacactaagttggtctgtgttgaggggggatgtgtgtactcagggctggagcggatggggggacagtttcttaccccacaaatgcaccacctttgaggggctcaattcccatcatagacatggaagatttatatatttatattgacaaaattccagcagaaggcaatcgagggtctcattctaggaaaggtccatctattatggaactggtcagtctcgtgatgagaaagtgacttgttttgatttgcacaggggtgccctgtaagcttgtcatggagctgcgcctacctgtgtgggtctgtgtggaaaaggctttctctccccaggagaatggtgctaggtctacctgttgaaggctctgggtctgttgtagaaggccaagtgccccccatggttggctgactgtatggccgagtgtacccccaatgagtgcctgtggatgactatctctctgtggatggcaagtgtctggccgtggatggccaactgttcagccatgggggaccaggtgttccccagtggatgggtgtcccctcctccgtggctgggtgtccaccgtggggggtcaggtattccccgtgaatggccatctgttggctcttggagaacagtgcattttcctgggaacacagccatggcccctccaccgccctctgccacttggcccatcatcagcagatctggaggtgatgggggcctggcctggcttccccagtccctgcagcttctctgcaaggctctgaggtgtggagcccatagggtgtgttgcgggggaaccggggcacagcaggaggcccccaggtggctctaggggttacatcccctcccttcccctgccag

SEQ ID NO: 3264 - DNA, 139 bp, Artificial Sequence
  Synthetic oligonucleotide
gctgaggccgcggaaggagcagggcacatacgccctgtccctcatctatgggaagacggtgtaccactacctcatcagccaagacaaggcgggcaagtactgcattcccgagggcaccaagtttgacacgctctggcag

SEQ ID NO: 3265 - DNA, 200 bp, Artificial Sequence
  Synthetic oligonucleotide
gtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttag

SEQ ID NO: 3266 - DNA, 924 bp, Artificial Sequence
  Synthetic oligonucleotide
gtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcattgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccag

SEQ ID NO: 3267 - DNA, 165 bp, Artificial Sequence
  Synthetic oligonucleotide
acaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtacc

SEQ ID NO: 3268 - DNA, 537 bp, Artificial Sequence
  Synthetic oligonucleotide
gtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattcttttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtgggccgagcagggccggtgcccctcgcccacgtgcctcccgtggccgggtcgggcag

SEQ ID NO: 3269 - DNA, 531 bp, Artificial Sequence
  Synthetic oligonucleotide
gtgagcaccgggtgggcccggccatcgggtgggtggggccggggcccatcctgggcatggtggacatgcacccgcgtgcatgcgtgtgtgggaagccggggcacttccacaccatcgtggacacactctcagcctgcacacccacacccatacccatgcctgcaaagcagagctaaccctcagtccaccattgcaccagtgcggtaataacagtgtctacctccagggcctttgcgaggatcgaatgagtcggcacctataaagggcactgctagggccgggtgcggtggctcatgcctgtaattccagcactttgggaggccaaggcgggtggatcatgaggtcaagagatccagaccatcctggccaacatggtgaaaccccgtccttactaaaaatacaaaagattagctgggcgtggtggtgggcgcctcccagctactcaggaggctgaggcaggagaatcgcttgaacccacgaggcggagcttgcagtgagccgagattgtgccactgcactccagcctgggga

SEQ ID NO: 3270 - DNA, 141 bp, Artificial Sequence
  Synthetic oligonucleotide
gcccgctcagcagggaagtggccgctcaagtggtacgcacccgaatgcatcaacttccgcaagttctccagccgcagcgatgtctggagctatggggtcaccatgtgggaggccttgtcctacggccagaagccctacaag

SEQ ID NO: 3271 - DNA, 296 bp, Artificial Sequence
  Synthetic oligonucleotide
cccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacactccagtccccaccagccagcacacagcacccaactaccagacag

SEQ ID NO: 3272 - DNA, 865 bp, Artificial Sequence
  Synthetic oligonucleotide
gtgagcactgaggtaccaaatactcatctattccagcccccacctctgcctggttgaagcccaaccttcagacatctcaactcctaacaccatcagtatcccaacttcccatcagacaacaggcaacacacccccagacaagcggacgccctagactgcccatgcaatgtgtggacactgtaacgcatgaccccccaccggccagcacttagcatgctgacaccccaacacccaagcagcccaacagatagacaccctctctggctggcccaccctcctgcgacatgtgttaattccacctccatcaggaaacacccagggcaccacaccccagtacccaaagaggctagcacctagcaccccaacacagtccatggataccccatgcacagtaccgttaatactgccgctccccgctggccagacccactgccatgctccaggcttctgctgatcaccagccttgcactccctctcatctaagccccagcacactgataccctggccccaggtgcatgcacagagcatcagctttctatatcccaggtccccgtggtcaatagttgccactctgacaccaagtccactcagtcccctgagtcctcactggtcaacgctcggtagaggggtcatcccagcaccctgtgtgtgggcagctctgcctccttaggctgtgtggcattgcccaacgctctcacaccccagagtcctctccaccacccaatgtcccgccaccccaacagccctgctgactttctgagccccaaaagtctacctcagccaagcacagtgcatgcccacccactggtgaagctgggtcctgggggcgtggtcagcagcctggatgtaccccacgccccacag

SEQ ID NO: 3273 - DNA, 128 bp, Artificial Sequence
  Synthetic oligonucleotide
gtgggaggatcgccccgacttcctgaccgtggagcagcgcatgcgagcctgttactacagcctggccagcaaggtggaagggcccccaggcagcacacagaaggctgaggctgcctgtgcctgagctc

SEQ ID NO: 3274 - DNA, 279 bp, Artificial Sequence
  Synthetic oligonucleotide
ccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcc

SEQ ID NO: 3275 - DNA, 745 bp, Artificial Sequence
  Synthetic oligonucleotide
cctgggccctgacattggagcctgggcatcctcaggtggtcaggcgtagatcaccagaataaacccagcttccctcttgtctgagcgccctcatcttttccggggtgagggtaggtgtcaggggaggggtgggttatgaaaagtgcatggaggtgactgttcttgtgtggactgagcctggaagtgacccctgggaagatggggctgggtcccactctccaccctagggacaccttcatgtgagtgagcggctggggtggagtggggaacctgaggccaggcgggtgtgggcccaagggctgcgtgcctggctgagcccagctcccctgtgtggagatgagtgtgccccatgccaggtgcacgttaggatcacctggagctattttaacaaacgctaaccccccctcccccatccagctggggtcttcacccccccaggggtgccttgcaaatcatgagatacaatgcttttcattggtagatgcacgtattagctcccgtatgaaccgtattactgaatttgaatctgaaaaataccaaaatgcaaacattgtttttaaattaattgttttaaaagctaatgaacgaattaagacaaattgcatcaatttagtggtttcttaaatcgtggtttgcaggtagttcagttttattaaaattcatttgtgagtcgctgaacgacttacattatgtaaaatatatcagacagtaaatgaattgtggctttcattgccttttggtcatc

SEQ ID NO: 3276 - DNA, 79 bp, Artificial Sequence
  Synthetic oligonucleotide
aaccggctctccattggcattgggaccagagaccccgcaagtggcctgtttgcctggacatccacctgtacgtccccag

SEQ ID NO: 3277 - DNA, 105 bp, Artificial Sequence
  Synthetic oligonucleotide
atatgggcacctggcaggcgcctggttcctgactgttggcgagaggctgggaaatgtgtcccaggtaggaagcatccccgacaggaaggaacaggagttcatgag

SEQ ID NO: 3278 - DNA, 10 bp, Artificial Sequence
  Synthetic oligonucleotide
gcaagttcct

SEQ ID NO: 3279 - DNA, 98 bp, Artificial Sequence
  Synthetic oligonucleotide
acagctggcacagtggtatgaggacaatgactcattctgggtaaacgtcaagagacgaagcagctacaaagagccaggctcctggaaaattaggcaag

SEQ ID NO: 3280 - DNA, 88 bp, Artificial Sequence
  Synthetic oligonucleotide
ctggtggagtatctgaagctgaaggcggacgggctcatctactgcctgaaggaggcctgccccaacagcagtgccagcaacgcctcag

SEQ ID NO: 3281 - DNA, 47 bp, Artificial Sequence
  Synthetic oligonucleotide
gggctgctgctcccacactcccagcccacccatccacgttgactcat

SEQ ID NO: 3282 - DNA, 31 bp, Artificial Sequence
  Synthetic oligonucleotide
cctcagagacgaatcgacaccctcaactcag

SEQ ID NO: 3283 - DNA, 21 bp, Artificial Sequence
  Synthetic oligonucleotide
atggatacacccctgagccag

SEQ ID NO: 3284 - DNA, 18 bp, Artificial Sequence
  Synthetic oligonucleotide
cacgcataacgtccccag

SEQ ID NO: 3285 - DNA, 10 bp, Artificial Sequence
  Synthetic oligonucleotide
gcatgcgcaa

SEQ ID NO: 3286 - DNA, 109 bp, Artificial Sequence
  Synthetic oligonucleotide
gaagcagatcgacgtggccatcaaggtgctgaagcagggcacggagaaggcagacacggaagagatgatgcgcgaggcgcagatcatgcaccagctggacaacccctac

SEQ ID NO: 3287 - DNA, 58 bp, Artificial Sequence
  Synthetic oligonucleotide
atcgtgcggctcattggcgtctgccaggccgaggccctcatgctggtcatggagatgg

SEQ ID NO: 3288 - DNA, 40 bp, Artificial Sequence
  Synthetic oligonucleotide
ctgggggcgggccgctgcacaagttcctggtcggcaagag

SEQ ID NO: 3289 - DNA, 115 bp, Artificial Sequence
  Synthetic oligonucleotide
ggaggagatccctgtgagcaatgtggccgagctgctgcaccaggtgtccatggggatgaagtacctggaggagaagaactttgtgcaccgtgacctggcggcccgcaacgtcctg

SEQ ID NO: 3290 - DNA, 78 bp, Artificial Sequence
  Synthetic oligonucleotide
ctggttaaccggcactacgccaagatcagcgactttggcctctccaaagcactgggtgccgacgacagctactacact

SEQ ID NO: 3291 - DNA, 113 bp, Artificial Sequence
  Synthetic oligonucleotide
aagatgaaagggccggaggtcatggccttcatcgagcagggcaagcggatggaatgcccaccagagtgtccacccgaactgtacgcactcatgagtgactgctggatctacaa

SEQ ID NO: 3292 - DNA, 106 bp, Artificial Sequence
  Synthetic oligonucleotide
gtgagtgccagtggggaggggacccggctgggctgacccctggaaagtcctggtgcccgatgagttgatgtcaatataactctacccaatgtaatctcacccaaag

SEQ ID NO: 3293 - DNA, 9924 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgatttttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtagcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtgagagtgaagtatctgctcttgggttacagaaccagatagtactagaactaagattacagggtaaagctgcttttatcttttttctttttctttttcttttttttttgacatggggtctcactgtattgcccaggctggaatgcagtggcatgatctcagctcacggcagcctctgcctcttgggctcaagcgattctcctgcttcagctttccaagtatttgggaccacaggcgcacaccacaggcctggctaatgtttttgttttgtttttggtagagacggggtttcaccatgttgccaggctggtctcgaactcctgagctcaagtgattcacccaccttggcctcacaaagtgtcaggcttacaggcgtgagccactgcgcccggctcacagggtaaggcttctgtctggtgtgttgtattacggattttgcttaataggcacagtgaggcattaaaaagaaaattcagtatgcctgtagaaaggataatccttgtttaaagtctccaaattgcagtcaaagatgttttgactgtgcctttttttgttcccctgctgtcccttatgtagacttctgtcagtacccatggcagcctgtcatcttgttgacatctccttctggactgtgagctctgtatctggcttgtttttcatccccagcttctagttcacaattaggtagaaccctattactctttgaagaaggaacaagaaaatgtgggccagttttcatttgccattcttccatgtgagttagtatggttcgtaagtattcctggtgatacgctagtattggcaattctgtgaggttgaacaaaggggtggtatggtgtgctagcgtgggaattaggagacctctgggtcttgacagtgccctggccactaagcaaaggcagttcatccttggagtctcaatgtgcttttttgttaattgagatatgcttgaagtatcagccctaaatagtctgattctgtgacctacaaacccttacttaattcagtgttactataaatgattcttcccttaaacctactttttacttagcaaaagagaaaaaaaaaaaaaggaaacgctcatgtcaggctgcctgggtttgaaccccagatcccctcttagttggaggcaagttgtatgatgcttcagcttttggttcctgcctcctaaggttgttaggagttactgtgtgtagctgcttagaacattgcctgggtctcagtaagccgcttaagtgactgctctcattttcgctgtaaagcaccatactgtaataacatcccatgaagcatggggcggggaagagtatatggtaccttatggactttgatgtggtggggtagtaggtaaattctgaatatgtaagctacatagtattctttttgtaactaaaggataaaagttttaagatgggcatgtaatatggctagcactggattttaatgatgagccagagtaataaggctggcaaggggagtttttgttttgtaataaatctcttacacctgcacatccagttctttttaaaaacacgtttgaagaggctccatatttctcagtgaagctgttggggttcatgttatttttgaaaatcatcttgcaatttatttcagcatcagactgaaccacccaaagaaaattagtctatttctgaacagttttttcagaaaccatattggtctgatcacccaacatttatagaaataggcgcttaaggcctagaggcatttcagaaaggagaatgagaaatactgtggtcaagagtagtgttcagatggagaacatcaagcatctgctctgcccttccacacacatcctcatttcatcttcacaactgccctaggtaaccttgttatctgtaatgaaacagcctcaaggagcacagaggcactcactcctcacgtttggtctgttgccatttccggcttggttggaatagggtaggagccttttggcagggagcacattctcagtaatgcagagtgcactcacctgggttctagcttcaacacttaggatttgcttgatattttgtattctctgaggcactgcctgtatttgtttctgctatcacagtccagagtcaagcttcatttataaagactgggcagggcatggtggctcactcctgtaattccagcactttgggaggctgaggtgggtggatcactttaggtcaggagttcaagaccagcctggccaacatggtgaaaccccatctctactaaaaaatacaaaaaggccgggcacggtggctcacacctgtaatcccaacactttgggaggccaaggtgggcagaacacctgaggtcaggagttcaagaccatcctggcgaacatagtgaaacctcgcctctactaaaaatacaaaaattagccaggtgtggtggtgcatgcctgtaatcccagctacttgggaggctgaggcaggagaattgcttaaacctgggaggtggagattgtggtgagctgagatcgtgccactgcactccagcctgggagatagaacgagactccatctcaaaaaagaacaaaaacaattagccgagcgaggtggtgcacgcctgtaatcccagctactcatgaggctgaggcaggagaatcacttgaacccaggaggaggaggttgtagtgagtcaaggttgcaccactgcactccagcctgggtgacagagtgagactgtctcaaaaaataagtacataaataataagtaaaagctactaacaattaaaaaataaataaataaagacaagactgtctggaaaatggctctcctaaaaggaccagttgccatcatccacagtggaagattcaaagcagttggtccttggtacgtatgagaagcggatttcattcccttgaattctacagagcagtttattagagtgaatgcattttaaggccttgcatttgatatgtcatccagttcataatcaagttgcctttttctggctaaaacataatgattatgtatttttctcatttggtcctacaagctgctggccctttgtccctccactgtgggaatcagatctagagcaggctgagcctgcagacacagcagtggccaaaaggtcactctaagtgttttgtcttgactccttacttgaagtccacccagctagcacacatctggtttatactgaagccccctgcctagaaatactcatttcaggaaccaccagtaagcatctgtgaccacacaggctttttgactgatggcttcccggatctggtttcaagggataaccccgtctgtgtgcatctatggtcttctctctacagcgaggactttgcagtgctgcttgtggtccacacaaggggctcagagctgagtctgaactgcttcatggtcaccagctcctgtcccttccagtcttgagaggcttttttctccagatggaacctttccttcccgccgttttctcggtctctggctgtttttctcttgtgcccgtctaattggacacctcctggcttccatctctgtggttctcctgcctcacttcctgttctgttgtttttccgttttgtcaaaatatctcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcgcttcagtcctgatttttagacctaaatggtttccttaacgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccaagtatggtgttttgtacacaggtatttaataagtgacttccagttttggctctgctatgaataaaaagagatttcagttctcttcactttgaaatctaacaactcagagaacattgaagaaattggaatttagttgggatgaaatacttgtggtttaaaatatttctgttcatattttctaatttgttgccggaggtcttgggttttctatttgagtgcttgcaaactcaatgtgatttctgtcagcatatcttaggtttgtttgttatgaaacttatgcagtgtgaggttctatctgaaaatgttatttagctatcttctgggactatttaatgaaagtggggtcatgaatccttaaaattcttgtgcagctttgagaaacatttctgttatttgggtatcagtttgtaagtgtggtaaagccaagatggaaacgagcactttgctttcttggttgttgttactggtctaacctcctgcttgaactagtctgctgtcctgtcaaatgcatctttttatttacatgtcccttaaattaaagctgatcatgaaagta

SEQ ID NO: 3294 - DNA, 3918 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgatttttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggcctacaaaaaaaaa

SEQ ID NO: 3295 - DNA, 2157 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaacatagattgagaacagttgaactcttaaatcctcagatgccaggggtctgctctagcatcaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggcctacaaaaaaaaa

SEQ ID NO: 3296 - DNA, 1911 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggcctacaaaaaaaaa

SEQ ID NO: 3297 - DNA, 1926 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcatgcagagtagaagagataaagcttcaccaagaaggttgcccaggaaacgggcacagaagagatcagtgggatctgatgaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggcctacaaaaaaaaa

SEQ ID NO: 3298 - DNA, 1328 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgc

SEQ ID NO: 3299 - DNA, 1391 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcacc

SEQ ID NO: 3300 - DNA, 161 bp, Artificial Sequence
  Synthetic oligonucleotide
cccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagag

SEQ ID NO: 3301 - DNA, 161 bp, Artificial Sequence
  Synthetic oligonucleotide
caacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcag

SEQ ID NO: 3302 - DNA, 143 bp, Artificial Sequence
  Synthetic oligonucleotide
tctggctctttcatccaggatggagtgcagtggcacaatcttgcttactgcaacctccgccttcggggctcaagtcatcctcccacctcagcttcctgagtagtcgaactacaggtgcacgccaccacacccagctaattttt

SEQ ID NO: 3303 - DNA, 350 bp, Artificial Sequence
  Synthetic oligonucleotide
gtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcacc

SEQ ID NO: 3304 - DNA, 272 bp, Artificial Sequence
  Synthetic oligonucleotide
cttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcag

SEQ ID NO: 3305 - DNA, 185 bp, Artificial Sequence
  Synthetic oligonucleotide
gtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaa

SEQ ID NO: 3306 - DNA, 409 bp, Artificial Sequence
  Synthetic oligonucleotide
gtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgatttttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttccca

SEQ ID NO: 3307 - DNA, 342 bp, Artificial Sequence
  Synthetic oligonucleotide
gtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccag

SEQ ID NO: 3308 - DNA, 498 bp, Artificial Sequence
  Synthetic oligonucleotide
ttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaa

SEQ ID NO: 3309 - DNA, 512 bp, Artificial Sequence
  Synthetic oligonucleotide
agcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttag

SEQ ID NO: 3310 - DNA, 748 bp, Artificial Sequence
  Synthetic oligonucleotide
atgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtagcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaaga

SEQ ID NO: 3311 - DNA, 370 bp, Artificial Sequence
  Synthetic oligonucleotide
ctagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacag

SEQ ID NO: 3312 - DNA, 986 bp, Artificial Sequence
  Synthetic oligonucleotide
gcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtgagagtgaagtatctgctcttgggttacagaaccagatagtactagaactaagattacagggtaaagctgcttttatcttttttctttttctttttcttttttttttgacatggggtctcact

SEQ ID NO: 3313 - DNA, 951 bp, Artificial Sequence
  Synthetic oligonucleotide
gtattgcccaggctggaatgcagtggcatgatctcagctcacggcagcctctgcctcttgggctcaagcgattctcctgcttcagctttccaagtatttgggaccacaggcgcacaccacaggcctggctaatgtttttgttttgtttttggtagagacggggtttcaccatgttgccaggctggtctcgaactcctgagctcaagtgattcacccaccttggcctcacaaagtgtcaggcttacaggcgtgagccactgcgcccggctcacagggtaaggcttctgtctggtgtgttgtattacggattttgcttaataggcacagtgaggcattaaaaagaaaattcagtatgcctgtagaaaggataatccttgtttaaagtctccaaattgcagtcaaagatgttttgactgtgcctttttttgttcccctgctgtcccttatgtagacttctgtcagtacccatggcagcctgtcatcttgttgacatctccttctggactgtgagctctgtatctggcttgtttttcatccccagcttctagttcacaattaggtagaaccctattactctttgaagaaggaacaagaaaatgtgggccagttttcatttgccattcttccatgtgagttagtatggttcgtaagtattcctggtgatacgctagtattggcaattctgtgaggttgaacaaaggggtggtatggtgtgctagcgtgggaattaggagacctctgggtcttgacagtgccctggccactaagcaaaggcagttcatccttggagtctcaatgtgcttttttgttaattgagatatgcttgaagtatcagccctaaatagtctgattctgtgacctacaaacccttacttaattcagtgttactataaatgattcttcccttaaacctactttttacttagcaaaagagaaaaaaaaaaaaaggaa

SEQ ID NO: 3314 - DNA, 186 bp, Artificial Sequence
  Synthetic oligonucleotide
acgctcatgtcaggctgcctgggtttgaaccccagatcccctcttagttggaggcaagttgtatgatgcttcagcttttggttcctgcctcctaaggttgttaggagttactgtgtgtagctgcttagaacattgcctgggtctcagtaagccgcttaagtgactgctctcattttcgctgtaaag

SEQ ID NO: 3315 - DNA, 1223 bp, Artificial Sequence
  Synthetic oligonucleotide
caccatactgtaataacatcccatgaagcatggggcggggaagagtatatggtaccttatggactttgatgtggtggggtagtaggtaaattctgaatatgtaagctacatagtattctttttgtaactaaaggataaaagttttaagatgggcatgtaatatggctagcactggattttaatgatgagccagagtaataaggctggcaaggggagtttttgttttgtaataaatctcttacacctgcacatccagttctttttaaaaacacgtttgaagaggctccatatttctcagtgaagctgttggggttcatgttatttttgaaaatcatcttgcaatttatttcagcatcagactgaaccacccaaagaaaattagtctatttctgaacagttttttcagaaaccatattggtctgatcacccaacatttatagaaataggcgcttaaggcctagaggcatttcagaaaggagaatgagaaatactgtggtcaagagtagtgttcagatggagaacatcaagcatctgctctgcccttccacacacatcctcatttcatcttcacaactgccctaggtaaccttgttatctgtaatgaaacagcctcaaggagcacagaggcactcactcctcacgtttggtctgttgccatttccggcttggttggaatagggtaggagccttttggcagggagcacattctcagtaatgcagagtgcactcacctgggttctagcttcaacacttaggatttgcttgatattttgtattctctgaggcactgcctgtatttgtttctgctatcacagtccagagtcaagcttcatttataaagactgggcagggcatggtggctcactcctgtaattccagcactttgggaggctgaggtgggtggatcactttaggtcaggagttcaagaccagcctggccaacatggtgaaaccccatctctactaaaaaatacaaaaaggccgggcacggtggctcacacctgtaatcccaacactttgggaggccaaggtgggcagaacacctgaggtcaggagttcaagaccatcctggcgaacatagtgaaacctcgcctctactaaaaatacaaaaattagccaggtgtggtggtgcatgcctgtaatcccagctacttgggaggctgaggcaggagaattgcttaaacctgggaggtggagattgtggtgagctgagatcgtgccac

SEQ ID NO: 3316 - DNA, 2249 bp, Artificial Sequence
  Synthetic oligonucleotide
tgcactccagcctgggagatagaacgagactccatctcaaaaaagaacaaaaacaattagccgagcgaggtggtgcacgcctgtaatcccagctactcatgaggctgaggcaggagaatcacttgaacccaggaggaggaggttgtagtgagtcaaggttgcaccactgcactccagcctgggtgacagagtgagactgtctcaaaaaataagtacataaataataagtaaaagctactaacaattaaaaaataaataaataaagacaagactgtctggaaaatggctctcctaaaaggaccagttgccatcatccacagtggaagattcaaagcagttggtccttggtacgtatgagaagcggatttcattcccttgaattctacagagcagtttattagagtgaatgcattttaaggccttgcatttgatatgtcatccagttcataatcaagttgcctttttctggctaaaacataatgattatgtatttttctcatttggtcctacaagctgctggccctttgtccctccactgtgggaatcagatctagagcaggctgagcctgcagacacagcagtggccaaaaggtcactctaagtgttttgtcttgactccttacttgaagtccacccagctagcacacatctggtttatactgaagccccctgcctagaaatactcatttcaggaaccaccagtaagcatctgtgaccacacaggctttttgactgatggcttcccggatctggtttcaagggataaccccgtctgtgtgcatctatggtcttctctctacagcgaggactttgcagtgctgcttgtggtccacacaaggggctcagagctgagtctgaactgcttcatggtcaccagctcctgtcccttccagtcttgagaggcttttttctccagatggaacctttccttcccgccgttttctcggtctctggctgtttttctcttgtgcccgtctaattggacacctcctggcttccatctctgtggttctcctgcctcacttcctgttctgttgtttttccgttttgtcaaaatatctcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcgcttcagtcctgatttttagacctaaatggtttccttaacgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccaagtatggtgttttgtacacaggtatttaataagtgacttccagttttggctctgctatgaataaaaagagatttcagttctcttcactttgaaatctaacaactcagagaacattgaagaaattggaatttagttgggatgaaatacttgtggtttaaaatatttctgttcatattttctaatttgttgccggaggtcttgggttttctatttgagtgcttgcaaactcaatgtgatttctgtcagcatatcttaggtttgtttgttatgaaacttatgcagtgtgaggttctatctgaaaatgttatttagctatcttctgggactatttaatgaaagtggggtcatgaatccttaaaattcttgtgcagctttgagaaacatttctgttatttgggtatcagtttgtaagtgtggtaaagccaagatggaaacgagcactttgctttcttggttgttgttactggtctaacctcctgcttgaactagtctgctgtcctgtcaaatgcatctttttatttacatgtcccttaaattaaagctgatcatgaaagtatttgtgtgcaacatgaaatgttttctaaagtaccagtgcatattcctgcttggtctcaagacgcacgaggaatccaaaatagaagcaaa

SEQ ID NO: 3317 - DNA, 855 bp, Artificial Sequence
  Synthetic oligonucleotide
acgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggcctacaaaaaaaaa

SEQ ID NO: 3318 - DNA, 117 bp, Artificial Sequence
  Synthetic oligonucleotide
ggcctgctctccccacctctccgcgctgagcagccacgtcggcggcggtccctggtccagggaggggcgtggcaaaggcccgtgcgcggtacgtgtcccgcccctcgctgcccggag

SEQ ID NO: 3319 - DNA, 113 bp, Artificial Sequence
  Synthetic oligonucleotide
gcttgttagcagtggcacaagatcttacagaggatgaagaaacagtagaagattccataattgaggatgaagatgatgaagccgaggtagaagaagatgaacccacagatttg

SEQ ID NO: 3320 - DNA, 4 bp, Artificial Sequence
  Synthetic oligonucleotide
gtag

SEQ ID NO: 3321 - DNA, 73 bp, Artificial Sequence
  Synthetic oligonucleotide
aagataaagaggaagaagatgtgtctggtgaacctgaagcttcaccgagtgcagatacaactatactgtttgt

SEQ ID NO: 3322 - DNA, 5 bp, Artificial Sequence
  Synthetic oligonucleotide
aaaag

SEQ ID NO: 3323 - DNA, 6 bp, Artificial Sequence
  Synthetic oligonucleotide
gagaag

SEQ ID NO: 3324 - DNA, 43 bp, Artificial Sequence
  Synthetic oligonucleotide
attttccagcaaataacattgtgaagttcctggtaggctttac

SEQ ID NO: 3325 - DNA, 59 bp, Artificial Sequence
  Synthetic oligonucleotide
agcccatgggcggacgaccatttggtttggtcatcaatctgaactacaaagatttgaac

SEQ ID NO: 3326 - DNA, 77 bp, Artificial Sequence
  Synthetic oligonucleotide
ggcaatgtattccaagatgcagtcttcaatcaaacagttacagttattgaaagagaggatgggttagatggagaaac

SEQ ID NO: 3327 - DNA, 79 bp, Artificial Sequence
  Synthetic oligonucleotide
aatctttatgtatatgttccttgctggtcttgggcttctggttattgttggccttcatcaactcctagaatctagaaag

SEQ ID NO: 3328 - DNA, 94 bp, Artificial Sequence
  Synthetic oligonucleotide
cgtaagagacccatacagaaagtagaaatgggtacatcaagtcagaatgatgttgacatgagttggattcctcaggaaacattgaatcaaatca

SEQ ID NO: 3329 - DNA, 17 bp, Artificial Sequence
  Synthetic oligonucleotide
gtaagtagtcttacaga

SEQ ID NO: 3330 - DNA, 15 bp, Artificial Sequence
  Synthetic oligonucleotide
tgcagagtagaagag

SEQ ID NO: 3331 - DNA, 32 bp, Artificial Sequence
  Synthetic oligonucleotide
gtgaggcatttaatttttttaatggtttttgc

SEQ ID NO: 3332 - DNA, 64 bp, Artificial Sequence
  Synthetic oligonucleotide
ataaagcttcaccaagaaggttgcccaggaaacgggcacagaagagatcagtgggatctgatga

SEQ ID NO: 3333 - DNA, 61 bp, Artificial Sequence
  Synthetic oligonucleotide
catagattgagaacagttgaactcttaaatcctcagatgccaggggtctgctctagcatca

SEQ ID NO: 3334 - DNA, 94 bp, Artificial Sequence
  Synthetic oligonucleotide
gtaagtatttagcagaaactaactccgtaatgaatggaattcaattccacacatggtttgttcaagcacacttaataagtagcctattttttaa

SEQ ID NO: 3335 - DNA, 8265 bp, Homo sapiens
ggtcatctagagctcctgtgggtgcgatgggcggagtcgagaacttcagattcccaggcctggctcttccctccagtagggatcggagacaaagagatgcgcccctgcagctccctaggttgagggctccgcccgcggccccaggggcttaggtgcggctgctcctccacttcccagcccgagggggcgctgcagcgcccggcgctcggcccgcccctacgccgcgctccgctcgcatcggcgctgcgggcggcgccgcggtgatacgttccccctcgccgcgctccccctcctcctctgccctccccgccggtggtaggtgccggaagtgccgccattttggggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaactgatgtcttcaga

SEQ ID NO: 3336 - DNA, 8133 bp, Homo sapiens
accgggtgacggcggggactggcctggactctgggggactggcgggactctggaggagggcccggcggcctcggaggagggaccgaggtctcctgggcgggaaactgggaccccggcgaagggagagcgcgtcgcaggccagacacgtgtgagccctgtagcgtgggaaactgaggcccccgcctgtggccggtgacctccctcctccgagggaggggggttgtgaccccagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaactgatgtcttcaga

SEQ ID NO: 3337 - DNA, 8338 bp, Homo sapiens
ggtaacattgtttatgttcatcgcacaatcatctggaaatataagaggtggagctctgttttggtctggagacctaactcgagcattatgattatacatgagtcagctacattcaaaggccagcattctagtccttagtttaatccttgaaaatcaagtgcttcttttctaacttctactgaaaggaaacttcacctgtcattgtatacattgaagtgttctgaatcttatttgtaatcaatagtcctttgttattttgtgggcctttttttaagtgtttgttttgttaactatgcttaaaagttattaaaacttgatcttgttttgggagttttaccctttaagttcctcctctagcatggtaattctcatgctagataagaaatgtacactgtcagttccctggtaacagctgggatgtcccaatcagaatggtgactttagtttggcatctgatggaatgggtggccatggtgagggagaaccagggaactctggtaaactgaatggaagtagtgaaagaagtagattttttttcccttacgttctcagaactagttaagatcattaaagaaaagaaaatttcctctggaaagcaacattattacataatagaagtttcattttatctcacacagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaactgatgtcttcaga

SEQ ID NO: 3338 - DNA, 2749 bp, Homo sapiens
ggtcatctagagctcctgtgggtgcgatgggcggagtcgagaacttcagattcccaggcctggctcttccctccagtagggatcggagacaaagagatgcgcccctgcagctccctaggttgagggctccgcccgcggccccaggggcttaggtgcggctgctcctccacttcccagcccgagggggcgctgcagcgcccggcgctcggcccgcccctacgccgcgctccgctcgcatcggcgctgcgggcggcgccgcggtgatacgttccccctcgccgcgctccccctcctcctctgccctccccgccggtggtaggtgccggaagtgccgccattttggggtgttctgctctggcggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcagtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctctatatatatgtatctctggacatgcatctctggttatatcttgaggcttttgctgcaactaaagtgaattcctggtttcccgttttaaagatttagaaacatcttgtgtccttgcctccaagaaagaaattcctgagggaatcttaactaccagtgtctttctccatatctctttctaccagatgtagagggcatcattaaaatccttattgagtctttcctaaagagtatgataaatgtttctttcagcggacttgagagatcaagagattttttttctttttttgctttatttatttatttatttatttattttttgagacggagtctcactcactctgtcacccaggctggagtgcagtggcacaatcttggcttactgcaacctccacctcgggttcaagtgattctcctgcctcaacttcccaagtagctgggactacagacacacaccatcacacccagctaatttttgtatttctagtagggatgggctttcactgtgttggccaggctggtctcgaactcacgacctcaggtgatccacctgtcttggcctcccaaagtgctgggtttacaggtgtgagccactgcgcctggcggagatcaagagattaacatgaacatttttaaatgagcattacaggtgtatattcaagtttactacattgtaaatagacttcctttaatttgatctctctgttgtcgtgagccaaaagaaggttgtctagtccaaaagaaggtctcgccccaatttgtgatttagatttactaggtctgcagtgtatatgttacaggggattattaatggaaaagaattgggccagcacaagacagttaaaaccacccatttgtgagtcaaagaggaaaaaggtcatcttaggctattaatggtgaaaccactagatttgtatggatgatacaaaaatattcacatagaaatagctagtatagtcatttattcctcatcatttcaagtattattctgtatggaaacagacaaaaggcactgatttctgtctcccagtactgaattttggtttagttccagtggttttcatatttctaatatcttataagaaatcccagtttaggccgggcgctgtgactcacgcctgtaatcccaacactttgggaggctgaggtgagtggatcgcctgaggttgggagtttgagaccagcctggccagcatggtgaaaccctgtctatactaaaaatacaaaaaaattacatgggtgtggtggcaggtgcctgtaatcccagctgctcgggaagctgaggcaggagaatggcttgaacctgggaggcggaggttgcactgagcggaggttgcagtgagccaagatcgcaccattgcactccagcctgggcaatagagcgagactctgtctcac

SEQ ID NO: 3339 - DNA, 232 bp, Artificial Sequence
  Synthetic oligonucleotide
accgggtgacggcggggactggcctggactctgggggactggcgggactctggaggagggcccggcggcctcggaggagggaccgaggtctcctgggcgggaaactgggaccccggcgaagggagagcgcgtcgcaggccagacacgtgtgagccctgtagcgtgggaaactgaggcccccgcctgtggccggtgacctccctcctccgagggaggggggttgtgaccccag

SEQ ID NO: 3340 - DNA, 364 bp, Artificial Sequence
  Synthetic oligonucleotide
ggtcatctagagctcctgtgggtgcgatgggcggagtcgagaacttcagattcccaggcctggctcttccctccagtagggatcggagacaaagagatgcgcccctgcagctccctaggttgagggctccgcccgcggccccaggggcttaggtgcggctgctcctccacttcccagcccgagggggcgctgcagcgcccggcgctcggcccgcccctacgccgcgctccgctcgcatcggcgctgcgggcggcgccgcggtgatacgttccccctcgccgcgctccccctcctcctctgccctccccgccggtggtaggtgccggaagtgccgccattttggggtgttctgctctggcggcag

SEQ ID NO: 3341 - DNA, 638 bp, Artificial Sequence
  Synthetic oligonucleotide
ggtaacattgtttatgttcatcgcacaatcatctggaaatataagaggtggagctctgttttggtctggagacctaactcgagcattatgattatacatgagtcagctacattcaaaggccagcattctagtccttagtttaatccttgaaaatcaagtgcttcttttctaacttctactgaaaggaaacttcacctgtcattgtatacattgaagtgttctgaatcttatttgtaatcaatagtcctttgttattttgtgggcctttttttaagtgtttgttttgttaactatgcttaaaagttattaaaacttgatcttgttttgggagttttaccctttaagttcctcctctagcatggtaattctcatgctagataagaaatgtacactgtcagttccctggtaacagctgggatgtcccaatcagaatggtgactttagtttggcatctgatggaatgggtggccatggtgagggagaaccagggaactctggtaaactgaatggaagtagtgaaagaagtagattttttttcccttacgttctcagaactagttaagatcattaaagaaaagaaaatttcctctggaaagcaacattattacataatagaagtttcattttatctcacacag

SEQ ID NO: 3342 - DNA, 188 bp, Artificial Sequence
  Synthetic oligonucleotide
ctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaag

SEQ ID NO: 3343 - DNA, 135 bp, Artificial Sequence
  Synthetic oligonucleotide
cagtggaagacaggaagctgtttattggtatgatttccaagaagtgcactgaaaatgacatccgagtcatgttctcttcgtttggacagattgaagaatgccggatattgcggggacctgatggcctgagccgag

SEQ ID NO: 3344 - DNA, 162 bp, Artificial Sequence
  Synthetic oligonucleotide
ggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagca

SEQ ID NO: 3345 - DNA, 1567 bp, Artificial Sequence
  Synthetic oligonucleotide
gtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctctatatatatgtatctctggacatgcatctctggttatatcttgaggcttttgctgcaactaaagtgaattcctggtttcccgttttaaagatttagaaacatcttgtgtccttgcctccaagaaagaaattcctgagggaatcttaactaccagtgtctttctccatatctctttctaccagatgtagagggcatcattaaaatccttattgagtctttcctaaagagtatgataaatgtttctttcagcggacttgagagatcaagagattttttttctttttttgctttatttatttatttatttatttattttttgagacggagtctcactcactctgtcacccaggctggagtgcagtggcacaatcttggcttactgcaacctccacctcgggttcaagtgattctcctgcctcaacttcccaagtagctgggactacagacacacaccatcacacccagctaatttttgtatttctagtagggatgggctttcactgtgttggccaggctggtctcgaactcacgacctcaggtgatccacctgtcttggcctcccaaagtgctgggtttacaggtgtgagccactgcgcctggcggagatcaagagattaacatgaacatttttaaatgagcattacaggtgtatattcaagtttactacattgtaaatagacttcctttaatttgatctctctgttgtcgtgagccaaaagaaggttgtctagtccaaaagaaggtctcgccccaatttgtgatttagatttactaggtctgcagtgtatatgttacaggggattattaatggaaaagaattgggccagcacaagacagttaaaaccacccatttgtgagtcaaagaggaaaaaggtcatcttaggctattaatggtgaaaccactagatttgtatggatgatacaaaaatattcacatagaaatagctagtatagtcatttattcctcatcatttcaagtattattctgtatggaaacagacaaaaggcactgatttctgtctcccagtactgaattttggtttagttccagtggttttcatatttctaatatcttataagaaatcccagtttaggccgggcgctgtgactcacgcctgtaatcccaacactttgggaggctgaggtgagtggatcgcctgaggttgggagtttgagaccagcctggccagcatggtgaaaccctgtctatactaaaaatacaaaaaaattacatgggtgtggtggcaggtgcctgtaatcccagctgctcgggaagctgaggcaggagaatggcttgaacctgggaggcggaggttgcactgagcggaggttgcagtgagccaagatcgcaccattgcactccagcctgggcaatagagcgagactctgtctcac

SEQ ID NO: 3346 - DNA, 129 bp, Artificial Sequence
  Synthetic oligonucleotide
ggttgaatgcaatgcagttacagaatttggctgcactagctgctgcagctagtgcagctcagaacacaccaagtggtaccaatgctctcactacatccagcagtcccctcagcgtgctcactagttcag

SEQ ID NO: 3347 - DNA, 186 bp, Artificial Sequence
  Synthetic oligonucleotide
gaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaag

SEQ ID NO: 3348 - DNA, 144 bp, Artificial Sequence
  Synthetic oligonucleotide
gtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttg

SEQ ID NO: 3349 - DNA, 859 bp, Artificial Sequence
  Synthetic oligonucleotide
gtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagcca

SEQ ID NO: 3350 - DNA, 233 bp, Artificial Sequence
  Synthetic oligonucleotide
gtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctcc

SEQ ID NO: 3351 - DNA, 148 bp, Artificial Sequence
  Synthetic oligonucleotide
ctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgt

SEQ ID NO: 3352 - DNA, 202 bp, Artificial Sequence
  Synthetic oligonucleotide
taagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacag

SEQ ID NO: 3353 - DNA, 1567 bp, Artificial Sequence
  Synthetic oligonucleotide
ctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacaca

SEQ ID NO: 3354 - DNA, 356 bp, Artificial Sequence
  Synthetic oligonucleotide
attcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcag

SEQ ID NO: 3355 - DNA, 276 bp, Artificial Sequence
  Synthetic oligonucleotide
ccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcagg

SEQ ID NO: 3356 - DNA, 904 bp, Artificial Sequence
  Synthetic oligonucleotide
ctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccag

SEQ ID NO: 3357 - DNA, 231 bp, Artificial Sequence
  Synthetic oligonucleotide
agggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcag

SEQ ID NO: 3358 - DNA, 433 bp, Artificial Sequence
  Synthetic oligonucleotide
tgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaa

SEQ ID NO: 3359 - DNA, 309 bp, Artificial Sequence
  Synthetic oligonucleotide
taggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctt

SEQ ID NO: 3360 - DNA, 265 bp, Artificial Sequence
  Synthetic oligonucleotide
gtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttgagaagaactgatgtcttcaga

SEQ ID NO: 3361 - DNA, 60 bp, Artificial Sequence
  Synthetic oligonucleotide
cggcagcggcggcgggacgcggaggctcccccgggattcggcctcagcagcgaggcggcg

SEQ ID NO: 3362 - DNA, 21 bp, Artificial Sequence
  Synthetic oligonucleotide
gcggcggctgcggaggcgcag

SEQ ID NO: 3363 - DNA, 40 bp, Artificial Sequence
  Synthetic oligonucleotide
gcagcaactgaggcagcggcaggctcaggtgcagccgctg

SEQ ID NO: 3364 - DNA, 83 bp, Artificial Sequence
  Synthetic oligonucleotide
ggtgctgttttgttacattttacacccgtaaagctgcattagaagctcagaatgctcttcacaacatgaaagtcctcccaggg

SEQ ID NO: 3365 - DNA, 49 bp, Artificial Sequence
  Synthetic oligonucleotide
atgcatcaccctatacagatgaaacctgctgacagtgagaagaacaatg

SEQ ID NO: 3366 - DNA, 72 bp, Artificial Sequence
  Synthetic oligonucleotide
gttgtgcatttgtgacttttacaacaagagccatggcacagacggctatcaaggcaatgcaccaagcacaga

SEQ ID NO: 3367 - DNA, 8 bp, Artificial Sequence
  Synthetic oligonucleotide
ccatggag

SEQ ID NO: 3368 - DNA, 12 bp, Artificial Sequence
  Synthetic oligonucleotide
ctttatttgcag

SEQ ID NO: 3369 - DNA, 64 bp, Artificial Sequence
  Synthetic oligonucleotide
ctccttcagcagactgcctcctctgggaacctcaacaccctgagcagcctccacccaatgggag

SEQ ID NO: 3370 - DNA, 114 bp, Artificial Sequence
  Synthetic oligonucleotide
cagggtcctcacctagctctagcagcagtaattctgtcaaccccatagcctcacttggagccctgcagacattagctggagcaacggctggcctcaatgttggctctttggcag

SEQ ID NO: 3371 - DNA, 58 bp, Artificial Sequence
  Synthetic oligonucleotide
gttttgtaagttacgacaatcctgtttcggcccaagctgccatccagtccatgaacgg

SEQ ID NO: 3372 - DNA, 109 bp, Artificial Sequence
  Synthetic oligonucleotide
ctttcagattggcatgaagcggcttaaagtgcagctcaaacgttcgaagaatgacagcaagccctactgagcgtgctcccctctgagactggagtgagagggtcttctg

SEQ ID NO: 3373 - DNA, 88 bp, Artificial Sequence
  Synthetic oligonucleotide
gtaagtgggggaggagcacccttaatgattcgaagccctgaggctgtgtgttgacagccctggaccctgatccctgccactctcgcag

SEQ ID NO: 3374 - DNA, 105 bp, Artificial Sequence
  Synthetic oligonucleotide
gcacagcttgccctgaagactcggctactgccttctgtgggagtttcgcttcgtacagaggacaagtttgtgctttggtttccagtgttttactttggagtttag

SEQ ID NO: 3375 - DNA, 4 bp, Artificial Sequence
  Synthetic oligonucleotide
gtag

SEQ ID NO: 3376 - DNA, 92 bp, Artificial Sequence
  Synthetic oligonucleotide
gtgagtgttcctgttctctctctctttgtttggatgtattgctctgtgtaactcagtgggtctccctctttctggtttgtttttttttctag

SEQ ID NO: 3377 - DNA, 116 bp, Artificial Sequence
  Synthetic oligonucleotide
ttttttggttccctgagggaaactgaccctcctctcttgtggcaccatccagcctcagggtcttggagacttgagtaagaatgtgagtggagggggagaggtgaggagaggagcac

SEQ ID NO: 3378 - DNA, 26 bp, Artificial Sequence
  Synthetic oligonucleotide
gttgcctggtattatgcccaaggccg

SEQ ID NO: 3379 - DNA, 38 bp, Artificial Sequence
  Synthetic oligonucleotide
ctctgcctgggggaaagggcagccaggcagaggcccag

SEQ ID NO: 3380 - DNA, 15 bp, Artificial Sequence
  Synthetic oligonucleotide
cgttgtatttaacac

SEQ ID NO: 3381 - DNA, 2811 bp, Homo sapiens
cgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagaggcatggggacaggaagcagagatcctggcctgtgaagagcgaatggcctgtctcttcctgagctcaagagtcaggtgcctgatccaagagtgggaaaagattgaaaagatggaggctgggttggactcacatgacagttgatttgaggcccttacttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaaaatggtca

SEQ ID NO: 3382 - DNA, 983 bp, Homo sapiens
cgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaat

SEQ ID NO: 3383 - DNA, 232 bp, Artificial Sequence
  Synthetic oligonucleotide
gcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacag

SEQ ID NO: 3384 - DNA, 156 bp, Artificial Sequence
  Synthetic oligonucleotide
aggcatggggacaggaagcagagatcctggcctgtgaagagcgaatggcctgtctcttcctgagctcaagagtcaggtgcctgatccaagagtgggaaaagattgaaaagatggaggctgggttggactcacatgacagttgatttgaggccctta

SEQ ID NO: 3385 - DNA, 477 bp, Artificial Sequence
  Synthetic oligonucleotide
gtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaat

SEQ ID NO: 3386 - DNA, 130 bp, Artificial Sequence
  Synthetic oligonucleotide
cggctcccagcatagctactggaagggaggccccactgtggaccccgaggagctgttcaggaagatctttggcgagttctcatcctcttcatttggagatttccagaccgtgtttgatcagcctcaggaa

SEQ ID NO: 3387 - DNA, 153 bp, Artificial Sequence
  Synthetic oligonucleotide
tacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatg

SEQ ID NO: 3388 - DNA, 148 bp, Artificial Sequence
  Synthetic oligonucleotide
gaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcag

SEQ ID NO: 3389 - DNA, 129 bp, Artificial Sequence
  Synthetic oligonucleotide
gtgcagaaaagccctgtgttccggagggacggcgcagacatccactccgacctctttatttctatagctcaggctcttcttgggggaacagccagagcccagggcctgtacgagacgatcaacgtgacg

SEQ ID NO: 3390 - DNA, 157 bp, Artificial Sequence
  Synthetic oligonucleotide
cagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattg

SEQ ID NO: 3391 - DNA, 261 bp, Artificial Sequence
  Synthetic oligonucleotide
cttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagaga

SEQ ID NO: 3392 - DNA, 333 bp, Artificial Sequence
  Synthetic oligonucleotide
gtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcag

SEQ ID NO: 3393 - DNA, 138 bp, Artificial Sequence
  Synthetic oligonucleotide
tttcctttttgttttcctttataattcactaaaataaagcatctattagtgtctgatttaggaatgtaaaatgattctgtattaatgtaaataagattatctattgcaaaaagatatttcaaacctaaaaaatggtca

SEQ ID NO: 3394 - DNA, 56 bp, Artificial Sequence
  Synthetic oligonucleotide
cgcctctacgcgcgcccgccgttcccgcgaggcccacctagagccgggcggcgcag

SEQ ID NO: 3395 - DNA, 56 bp, Artificial Sequence
  Synthetic oligonucleotide
gaacaaaacattaccctttcatttgtactgcctccttccacacgagtgcccctttg

SEQ ID NO: 3396 - DNA, 78 bp, Artificial Sequence
  Synthetic oligonucleotide
gccaaagaagattattatcagatattaggagtgcctcgaaatgccagccagaaagagatcaagaaagcctattatcag

SEQ ID NO: 3397 - DNA, 84 bp, Artificial Sequence
  Synthetic oligonucleotide
cttgccaagaagtatcaccctgacacaaataaggatgatcccaaagccaaggagaagttctcccagctggcagaagcctatgag

SEQ ID NO: 3398 - DNA, 45 bp, Artificial Sequence
  Synthetic oligonucleotide
gttttgagtgatgaggtgaagaggaagcagtacgatgcctacggc

SEQ ID NO: 3399 - DNA, 26 bp, Artificial Sequence
  Synthetic oligonucleotide
tctgcaggcttcgatcctggggccag

SEQ ID NO: 3400 - DNA, 65 bp, Artificial Sequence
  Synthetic oligonucleotide
gagtcgaggatggccagaccgtgaggatgcctgtgggaaaaagggaaattttcattacgttcagg

SEQ ID NO: 3401 - DNA, 116 bp, Artificial Sequence
  Synthetic oligonucleotide
atcccccctgggactcagacagaccagaagattcggatgggtgggaaaggcatcccccggattaacagctacggctacggagaccactacatccacatcaagatacgagttccaaa

SEQ ID NO: 3402 - DNA, 98 bp, Artificial Sequence
  Synthetic oligonucleotide
gaggctaacgagccggcagcagagcctgatcctgagctacgccgaggacgagacagatgtggaggggacggtgaacggcgtcaccctcaccagctctg

SEQ ID NO: 3403 - DNA, 78 bp, Artificial Sequence
  Synthetic oligonucleotide
gaaaaagatccactggaaactaggccgggaagcagcagcccctccaagggccagggcacctgggagacgggaggattc

SEQ ID NO: 3404 - DNA, 59 bp, Artificial Sequence
  Synthetic oligonucleotide
gtaggtgacggcccctggctcaggcagagggagatggttagactcttgcagggctaaaa

SEQ ID NO: 3405 - DNA, 54 bp, Artificial Sequence
  Synthetic oligonucleotide
ctctaatttggaattgaatattgtggatatcttagttaaaggccatgcttacag

SEQ ID NO: 3406 - DNA, 55 bp, Artificial Sequence
  Synthetic oligonucleotide
aaaaggaaagcacaggctaagcagttgaaggttccccaccattcagtgagagcag

SEQ ID NO: 3407 - DNA, 55 bp, Artificial Sequence
  Synthetic oligonucleotide
aacccccattccccagcctctgctggtagcatgtcgcagtttccatgtgtttcag

SEQ ID NO: 3408 - DNA, 49 bp, Artificial Sequence
  Synthetic oligonucleotide
gatcttcgggctgtcgttagacaggttaatgaagaacacttctcaacag

SEQ ID NO: 3409 - DNA, 3108 bp, Homo sapiens
ccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagcc

SEQ ID NO: 3410 - DNA, 1953 bp, Homo sapiens
ctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagcc

SEQ ID NO: 3411 - DNA, 3059 bp, Homo sapiens
ccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcgcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagcc

SEQ ID NO: 3412 - DNA, 127 bp, Artificial Sequence
  Synthetic oligonucleotide
ctctcgtgccgcaccgtagggggcggtgtcggagttctgtctgggcctattcgggtccgagttcggaatttcggttcaaggcccagttcctcggattgttcctgcgcaacttcagtttcccttccag

SEQ ID NO: 3413 - DNA, 1140 bp, Artificial Sequence
  Synthetic oligonucleotide
ccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaag

SEQ ID NO: 3414 - DNA, 153 bp, Artificial Sequence
  Synthetic oligonucleotide
gagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtag

SEQ ID NO: 3415 - DNA, 122 bp, Artificial Sequence
  Synthetic oligonucleotide
agaggcgtgagcgagcccgttgtccggagtgcacctgctgcctgttctgtccctcccgggagcccccgccgctgtcgccgtcgagtcgccatggaagtgcagaaagaggcacagcgcatcat

SEQ ID NO: 3416 - DNA, 280 bp, Artificial Sequence
  Synthetic oligonucleotide
ccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgc

SEQ ID NO: 3417 - DNA, 343 bp, Artificial Sequence
  Synthetic oligonucleotide
ctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccat

SEQ ID NO: 3418 - DNA, 178 bp, Artificial Sequence
  Synthetic oligonucleotide
cttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccc

SEQ ID NO: 3419 - DNA, 385 bp, Artificial Sequence
  Synthetic oligonucleotide
cttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaag

SEQ ID NO: 3420 - DNA, 191 bp, Artificial Sequence
  Synthetic oligonucleotide
gcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagcc

SEQ ID NO: 3421 - DNA, 11 bp, Artificial Sequence
  Synthetic oligonucleotide
gcacgggcaat

SEQ ID NO: 3422 - DNA, 44 bp, Artificial Sequence
  Synthetic oligonucleotide
gaccctgtcggtgtggaagatgtatcactcccgcatgcagcgcg

SEQ ID NO: 3423 - DNA, 49 bp, Artificial Sequence
  Synthetic oligonucleotide
gtggcctgcggctgcaccggagtctgcagctgtcgctggtcatgcgcag

SEQ ID NO: 3424 - DNA, 104 bp, Artificial Sequence
  Synthetic oligonucleotide
cgcccgggagctctacctctcggccaaggtggaggccctcgagcccgaggtgtcgttgccggccgccctcccctctgaccctcgcctgcacccgccccgagaag

SEQ ID NO: 3425 - DNA, 54 bp, Artificial Sequence
  Synthetic oligonucleotide
cgccttcagtgtgcagggacggcaccgaggagtctgagccgggggcgcgggcgc

SEQ ID NO: 3426 - DNA, 65 bp, Artificial Sequence
  Synthetic oligonucleotide
cttccgcagagacctgcgcccacaggtgctgtcttagtggactgggacgtgaacctttcgctctc

SEQ ID NO: 3427 - DNA, 2920 bp, Homo sapiens
tcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3428 - DNA, 2491 bp, Homo sapiens
aaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagagtagaattgtggttaattcaatttgcagaattttggatgaaaaatactggctcagtcactctccacagcccgcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3429 - DNA, 2699 bp, Homo sapiens
aaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagagtagaattgtggttaattcaatttgcagaattttggatgaaaaatactggctcagtcactctccacagcccgcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3430 - DNA, 2912 bp, Homo sapiens
aaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagagtagaattgtggttaattcaatttgcagaattttggatgaaaaatactggctcagtcactctccacagcccgcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3431 - DNA, 2736 bp, Homo sapiens
aaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagagtagaattgtggttaattcaatttgcagaattttggatgaaaaatactggctcagtcactctccacagcccgcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3432 - DNA, 3133 bp, Homo sapiens
tcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3433 - DNA, 2164 bp, Homo sapiens
aaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3434 - DNA, 2727 bp, Homo sapiens
tcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3435 - DNA, 1305 bp, Artificial Sequence
  Synthetic oligonucleotide
tcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacag

SEQ ID NO: 3436 - DNA, 549 bp, Artificial Sequence
  Synthetic oligonucleotide
aaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggag

SEQ ID NO: 3437 - DNA, 327 bp, Artificial Sequence
  Synthetic oligonucleotide
gtgagagtagaattgtggttaattcaatttgcagaattttggatgaaaaatactggctcagtcactctccacagcccgcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaa

SEQ ID NO: 3438 - DNA, 208 bp, Artificial Sequence
  Synthetic oligonucleotide
gtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacag

SEQ ID NO: 3439 - DNA, 164 bp, Artificial Sequence
  Synthetic oligonucleotide
gggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaag

SEQ ID NO: 3440 - DNA, 176 bp, Artificial Sequence
  Synthetic oligonucleotide
gtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccag

SEQ ID NO: 3441 - DNA, 350 bp, Artificial Sequence
  Synthetic oligonucleotide
gtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatg

SEQ ID NO: 3442 - DNA, 193 bp, Artificial Sequence
  Synthetic oligonucleotide
gtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctag

SEQ ID NO: 3443 - DNA, 908 bp, Artificial Sequence
  Synthetic oligonucleotide
gcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 3444 - DNA, 37 bp, Artificial Sequence
  Synthetic oligonucleotide
tcccctctggtcccccctcccggcttttgtcttgcag

SEQ ID NO: 3445 - DNA, 3403 bp, Homo sapiens
cctgtgggaggatcgggccagccctggtagggggcgcggtcccgggtggcccggggcgggggcgcggccttttcagggaaggcctcagggcgttgcgctggcctaggggaggggtcgtcgtgggcgtagcctggaaggactgggggccgcgtactcagcccctctagtgggagcgcctccgcagggtcggctcgtcgggaggatgggctccgcggcttggcctgccttttggggatggggctgtccgaggggctgggcccggatcgccggaggggccagggtctcctgcacaggagtgagcccccacgttccccatacctgtcctggttagggggtccccggggaaacccggacactgagccgcctaagtcggcctgagccggtggtctggggccgaagcaggatccggctgcaccgcattgcgtctcccaggcctagacaagctaggcgcgccctctgtaggccaagcgcgggcacggtgcgggctgccggctgggggacctgggcacacgggagactcaggcgtccggggaccgcctgtttacctaatccggggcggacggcggtgtggccccaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgatcccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgagctggg

SEQ ID NO: 3446 - DNA, 3871 bp, Homo sapiens
ctggcacgtgaaccctggggaagttgtatcattttggtttccttgtctttaaaatagggatcatgccatctgctgtgtacacttccaggctgttgggggaatttttttttttttttaaagctagtggttatggaaacacctgtcacttaggcatttgctaaccaacaacaaagtacagggtctcagacagcctggccctctgcaaggacattcactccctgccagttggccgtcagaggtagagaggaccactcaggggccgcacacctggtggagcacgtgcactctcacagagggggaacaatctgcacggagggcatgggcatcaaggccatgtgtgaagctggagcaaagtgggaggtgtgactagctggagacacaactgcagaaatgatcctgaaccgggaaggactgggaaagggtggaggccgggtgtggtggctcacgcctgtaattccagcactttgggaggcccaggtgggaagactgcttaaatcccggacttcatgagaccctgtatctacaaaaaataatttttctttttttttttgagacagtcttgctctgttgcccaggctgcagtgagctgtgacggtgccatagcccttcggcccaggtgacagagtgagacattgtcttaaattaaaaaaaaaaaaaaaaagagagagcaagaagggaggttggaccctaggcaggaaggcaggaagagactggaaactaaggaaaggagttgcagaggctggggagaggggtgggggttgaggccaaggcctttggatacttttcctgcccctgtggctcctcatgccaactgagcatttgggacacatgccccttccctacctgggagctgcagaaaggcaggggatgctgtggcccctcagcagaagtggggatggagtctttgggtggtccttcagccatctagcagagttctgtgggcaagcgctagccctgaggcagggagcagtaacctactggctgtggcagcagaggcttgagtacaacccagggagagacgaaggaaggggctagtagctcagggaaagcacagcaccccaactagcccttttggggttctcctgatcctagaaggaaggaactggggactcccaagcctcctgggtttgggctttgcattatggtgtgtcgggggccttgaggagattctcccttgacaagcagagaaaagacctgcagctcctcactgtagggccaggcctggcccttcactgggtcccagagcccaactaggcccaggctacagtcataggcgagggggtcgacaggcctccgacccttacctgggctggttgcacaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgatcccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgagctggg

SEQ ID NO: 3447 - DNA, 3172 bp, Homo sapiens
cctgtgggaggatcgggccagccctggtagggggcgcggtcccgggtggcccggggcgggggcgcggccttttcagggaaggcctcagggcgttgcgctggcctaggggaggggtcgtcgtgggcgtagcctggaaggactgggggccgcgtactcagcccctctagtgggagcgcctccgcagggtcggctcgtcgggaggatgggctccgcggcttggcctgccttttggggatggggctgtccgaggggctgggcccggatcgccggaggggccagggtctcctgcacaggagtgagcccccacgttccccatacctgtcctggttagggggtccccggggaaacccggacactgagccgcctaagtcggcctgagccggtggtctggggccgaagcaggatccggctgcaccgcattgcgtctcccaggcctagacaagctaggcgcgccctctgtaggccaagcgcgggcacggtgcgggctgccggctgggggacctgggcacacgggagactcaggcgtccggggaccgcctgtttacctaatccggggcggacggcggtgtggccccaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgatcccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgagctggg

SEQ ID NO: 3448 - DNA, 2552 bp, Homo sapiens
actctctgggggtgcccaaattcttctggaaggctccagccctggatcactaacccttggtgcctgctgtgggccaggactcgtggcccacctgcgtggagctgggctacagatgcaagtaaaactgtctagtgtaagagagaggcttggccagaactggggagggactgcacatgaggactccaggggtcctggggagtccacacagcttctccaggcaccaaggctggaggaggggctttgccagaaagtgagtttgcccaaacacaagagggctagaaaaggttcccatggcaaaaagccagcatgagcaaaggcactgggacctggagagcaggacacgctaaaggggcagcaggagagccatgtggcgcccaggaatgctaggcaccaggcagtcggtgggaccccagcactgcgcaccccagccaattgtgagaaaactgcctacagcccttggagcttggagagcaggagctgagcaggtctccccacactctgggtctcactctgtcatacacactcaggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgatcccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgagctggg

SEQ ID NO: 3449 - DNA, 1528 bp, Homo sapiens
ggcggcgcgggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgatcccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacaggtgagtggggcggggctgggctggggagcagggcacggcagggcgggctccacattccata

SEQ ID NO: 3450 - DNA, 577 bp, Artificial Sequence
  Synthetic oligonucleotide
cctgtgggaggatcgggccagccctggtagggggcgcggtcccgggtggcccggggcgggggcgcggccttttcagggaaggcctcagggcgttgcgctggcctaggggaggggtcgtcgtgggcgtagcctggaaggactgggggccgcgtactcagcccctctagtgggagcgcctccgcagggtcggctcgtcgggaggatgggctccgcggcttggcctgccttttggggatggggctgtccgaggggctgggcccggatcgccggaggggccagggtctcctgcacaggagtgagcccccacgttccccatacctgtcctggttagggggtccccggggaaacccggacactgagccgcctaagtcggcctgagccggtggtctggggccgaagcaggatccggctgcaccgcattgcgtctcccaggcctagacaagctaggcgcgccctctgtaggccaagcgcgggcacggtgcgggctgccggctgggggacctgggcacacgggagactcaggcgtccggggaccgcctgtttacctaatccggggcggacggcggtgtggccccag

SEQ ID NO: 3451 - DNA, 239 bp, Artificial Sequence
  Synthetic oligonucleotide
acgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccag

SEQ ID NO: 3452 - DNA, 575 bp, Artificial Sequence
  Synthetic oligonucleotide
ctggcacgtgaaccctggggaagttgtatcattttggtttccttgtctttaaaatagggatcatgccatctgctgtgtacacttccaggctgttgggggaatttttttttttttttaaagctagtggttatggaaacacctgtcacttaggcatttgctaaccaacaacaaagtacagggtctcagacagcctggccctctgcaaggacattcactccctgccagttggccgtcagaggtagagaggaccactcaggggccgcacacctggtggagcacgtgcactctcacagagggggaacaatctgcacggagggcatgggcatcaaggccatgtgtgaagctggagcaaagtgggaggtgtgactagctggagacacaactgcagaaatgatcctgaaccgggaaggactgggaaagggtggaggccgggtgtggtggctcacgcctgtaattccagcactttgggaggcccaggtgggaagactgcttaaatcccggacttcatgagaccctgtatctacaaaaaataatttttctttttttttttgagacagtcttgctctgttgcccag

SEQ ID NO: 3453 - DNA, 746 bp, Artificial Sequence
  Synthetic oligonucleotide
gctgcagtgagctgtgacggtgccatagcccttcggcccaggtgacagagtgagacattgtcttaaattaaaaaaaaaaaaaaaaagagagagcaagaagggaggttggaccctaggcaggaaggcaggaagagactggaaactaaggaaaggagttgcagaggctggggagaggggtgggggttgaggccaaggcctttggatacttttcctgcccctgtggctcctcatgccaactgagcatttgggacacatgccccttccctacctgggagctgcagaaaggcaggggatgctgtggcccctcagcagaagtggggatggagtctttgggtggtccttcagccatctagcagagttctgtgggcaagcgctagccctgaggcagggagcagtaacctactggctgtggcagcagaggcttgagtacaacccagggagagacgaaggaaggggctagtagctcagggaaagcacagcaccccaactagcccttttggggttctcctgatcctagaaggaaggaactggggactcccaagcctcctgggtttgggctttgcattatggtgtgtcgggggccttgaggagattctcccttgacaagcagagaaaagacctgcagctcctcactgtagggccaggcctggcccttcactgggtcccagagcccaactaggcccaggctacagtcataggcgagggggtcgacaggcctccgacccttacctgggctggttgcacag

SEQ ID NO: 3454 - DNA, 195 bp, Artificial Sequence
  Synthetic oligonucleotide
gaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaac

SEQ ID NO: 3455 - DNA, 223 bp, Artificial Sequence
  Synthetic oligonucleotide
cccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcg

SEQ ID NO: 3456 - DNA, 225 bp, Artificial Sequence
  Synthetic oligonucleotide
actctctgggggtgcccaaattcttctggaaggctccagccctggatcactaacccttggtgcctgctgtgggccaggactcgtggcccacctgcgtggagctgggctacagatgcaagtaaaactgtctagtgtaagagagaggcttggccagaactggggagggactgcacatgaggactccaggggtcctggggagtccacacagcttctccaggcaccaag

SEQ ID NO: 3457 - DNA, 301 bp, Artificial Sequence
  Synthetic oligonucleotide
gctggaggaggggctttgccagaaagtgagtttgcccaaacacaagagggctagaaaaggttcccatggcaaaaagccagcatgagcaaaggcactgggacctggagagcaggacacgctaaaggggcagcaggagagccatgtggcgcccaggaatgctaggcaccaggcagtcggtgggaccccagcactgcgcaccccagccaattgtgagaaaactgcctacagcccttggagcttggagagcaggagctgagcaggtctccccacactctgggtctcactctgtcatacacactca

SEQ ID NO: 3458 - DNA, 174 bp, Artificial Sequence
  Synthetic oligonucleotide
gtcctgggcaagtttcacccagatgtggccaagcagctcagcaacctggccctgctgtgccagaaccagggcaaagctgaggaggtggaatattactatcggcgggcactggagatctatgctacacgcctcgggcccgatgatcccaatgtggccaagaccaagaacaacctg

SEQ ID NO: 3459 - DNA, 159 bp, Artificial Sequence
  Synthetic oligonucleotide
ggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggg

SEQ ID NO: 3460 - DNA, 125 bp, Artificial Sequence
  Synthetic oligonucleotide
gatggcagtggctccttgaggcgcagcggttcctttgggaaactccgggatgccctgaggcgcagcagtgagatgctggtaaagaagctgcaggggggcaccccccaggagccccctaaccccag

SEQ ID NO: 3461 - DNA, 301 bp, Artificial Sequence
  Synthetic oligonucleotide
cctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcag

SEQ ID NO: 3462 - DNA, 134 bp, Artificial Sequence
  Synthetic oligonucleotide
ccttcagtccacggtactacccgggcctcccctcgtccctcttctagtggtaccgcccaggccttaatcacccccattccgtgcggtggtatctcccaggctctacattctcgggagcggcgcctcccaagggg

SEQ ID NO: 3463 - DNA, 59 bp, Artificial Sequence
  Synthetic oligonucleotide
ggcggcgcgggggctgctgggaaggccggcgggatggaggcggcgggaccggctcgcgg

SEQ ID NO: 3464 - DNA, 63 bp, Artificial Sequence
  Synthetic oligonucleotide
gtgcgggtccgggtgaagcgggaggcagccagagtcggagccgggcccgagcaccaggcgcag

SEQ ID NO: 3465 - DNA, 37 bp, Artificial Sequence
  Synthetic oligonucleotide
gcccggcgcccgcctgcccgcaccctcgtcctcacag

SEQ ID NO: 3466 - DNA, 36 bp, Artificial Sequence
  Synthetic oligonucleotide
gtgatcttggcattgtcgagccacctgggggctgta

SEQ ID NO: 3467 - DNA, 47 bp, Artificial Sequence
  Synthetic oligonucleotide
gaggagaagggggacgtccccaaagacacactggatgacctgttccc

SEQ ID NO: 3468 - DNA, 23 bp, Artificial Sequence
  Synthetic oligonucleotide
caatgaggatgagcagagcccag

SEQ ID NO: 3469 - DNA, 19 bp, Artificial Sequence
  Synthetic oligonucleotide
ggatcagaacaagtacaag

SEQ ID NO: 3470 - DNA, 69 bp, Artificial Sequence
  Synthetic oligonucleotide
gaggctgcccacctgctcaatgatgctctggccatccgggagaaaacactgggcaaggaccacccagcc

SEQ ID NO: 3471 - DNA, 102 bp, Artificial Sequence
  Synthetic oligonucleotide
gtggctgcgacactaaacaacctggcagtcctgtatggcaagaggggcaagtacaaggaggctgagccattgtgcaagcgggcactggagatccgggagaag

SEQ ID NO: 3472 - DNA, 100 bp, Artificial Sequence
  Synthetic oligonucleotide
gcttcctgctacctgaagcagggcaagtaccaggatgcggagaccttgtacaaggagatcctcacccgcgctcatgagaaagagtttggctctgtcaatg

SEQ ID NO: 3473 - DNA, 50 bp, Artificial Sequence
  Synthetic oligonucleotide
gggacaacaagcccatctggatgcacgcagaggagcgggaggaaagcaag

SEQ ID NO: 3474 - DNA, 29 bp, Artificial Sequence
  Synthetic oligonucleotide
gataagcgccgggacagcgccccctatgg

SEQ ID NO: 3475 - DNA, 39 bp, Artificial Sequence
  Synthetic oligonucleotide
ggaatacggcagctggtacaaggcctgtaaagtagacag

SEQ ID NO: 3476 - DNA, 61 bp, Artificial Sequence
  Synthetic oligonucleotide
gtgagtggggcggggctgggctggggagcagggcacggcagggcgggctccacattccata

SEQ ID NO: 3477 - DNA, 109 bp, Artificial Sequence
  Synthetic oligonucleotide
ccccacagtcaacaccaccctgcgcagcttgggggccctataccggcgccagggcaagctggaagccgcgcacacactagaggactgtgccagccgtaaccgcaagcag

SEQ ID NO: 3478 - DNA, 58 bp, Artificial Sequence
  Synthetic oligonucleotide
gatgaagcgggccagttccctcaacttcctcaacaagagcgtggaagagccgacccag

SEQ ID NO: 3479 - DNA, 29 bp, Artificial Sequence
  Synthetic oligonucleotide
ggccctcttccctaggttcgggccagcag

SEQ ID NO: 3480 - DNA, 104 bp, Artificial Sequence
  Synthetic oligonucleotide
gaggtgccggctggagtctccaccatagactcagtggcctggcctccccagaccccagagccaagaacactaagcactcgccggcccttcggcaccctcgccct

SEQ ID NO: 3481 - DNA, 65 bp, Artificial Sequence
  Synthetic oligonucleotide
ccctcccgactcaacccggccgttgcttctgtatatagagaaataagttattggccgcgcgcctc

SEQ ID NO: 3482 - DNA, 106 bp, Artificial Sequence
  Synthetic oligonucleotide
gtcctgggaccttctcgcgctcctcctggcctctgagggatgcgtcctacccgcgccatcgccccgtggcccaggacggggacctccccttagtccgtcctcccac

SEQ ID NO: 3483 - DNA, 60 bp, Artificial Sequence
  Synthetic oligonucleotide
cgccgggccctgccccgcatcccggccttatgcactgcccctcccacccggccccgccca

SEQ ID NO: 3484 - DNA, 69 bp, Artificial Sequence
  Synthetic oligonucleotide
ggcacggccgaccccgccccgggcaccgcccaccgagccatcctgcctcgcctccccccacgcctgcag

SEQ ID NO: 3485 - DNA, 22 bp, Artificial Sequence
  Synthetic oligonucleotide
cttctcgcgaggggcggcgacg

SEQ ID NO: 3486 - DNA, 26 bp, Artificial Sequence
  Synthetic oligonucleotide
gtcccctggtggcaggaggggctccc

SEQ ID NO: 3487 - DNA, 77 bp, Artificial Sequence
  Synthetic oligonucleotide
cctgttgcgggtgaggcggctgctctctattttcagatgttgctgtagaaataaagacggtttaaatctgagctggg

SEQ ID NO: 3488 - DNA, 3039 bp, Homo sapiens
agtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagga

SEQ ID NO: 3489 - DNA, 454 bp, Artificial Sequence
  Synthetic oligonucleotide
agtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaa

SEQ ID NO: 3490 - DNA, 131 bp, Artificial Sequence
  Synthetic oligonucleotide
tgcccgagccatggcactgcctcggacgctgggggagctgcagctgtaccgggtcctgcagcgcgccaacctcctttcctactatgagaccttcatccagcagggaggggacgacgtgcagcagctgtgtg

SEQ ID NO: 3491 - DNA, 225 bp, Artificial Sequence
  Synthetic oligonucleotide
aggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccag

SEQ ID NO: 3492 - DNA, 162 bp, Artificial Sequence
  Synthetic oligonucleotide
gggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggagg

SEQ ID NO: 3493 - DNA, 228 bp, Artificial Sequence
  Synthetic oligonucleotide
atggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgag

SEQ ID NO: 3494 - DNA, 134 bp, Artificial Sequence
  Synthetic oligonucleotide
ctcaccatcaacgaggctgctgcccagttctgcatgagggacaacacgctcttattacggagagtggagctcttctctttgtcccgccaagtagcccgagagagcacctacttgtcctccttgaagggctccag

SEQ ID NO: 3495 - DNA, 335 bp, Artificial Sequence
  Synthetic oligonucleotide
gtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcag

SEQ ID NO: 3496 - DNA, 192 bp, Artificial Sequence
  Synthetic oligonucleotide
ctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcag

SEQ ID NO: 3497 - DNA, 309 bp, Artificial Sequence
  Synthetic oligonucleotide
agttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagg

SEQ ID NO: 3498 - DNA, 210 bp, Artificial Sequence
  Synthetic oligonucleotide
gtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccct

SEQ ID NO: 3499 - DNA, 1413 bp, Artificial Sequence
  Synthetic oligonucleotide
cccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggatctatgacccctgccttgagagggagaatgggataggggagtgaagggaagctggcggtggatggggcaacagaaaagatgcagcaggcagggccctctcatacactggagggccacatggccaggcctggacccagactctcaccctggctcccaggcagcattggaggtgtggagccatacgtagatgtcacagccacttggacccacttgggcacagtcagactccaaattcagagtatttgggggttagcatatgtcagagaggccagcacacttgctgctgtcttctgtgcagtgtctcaccctcccaaatttgtgttgtcacgtaggcaaaagcagatagacacatgttctatgtggtcatgcaactaaggtgccagctatatatttaacatatcctaggtacatacacgttcacacagctatacacgaagaatctcagcccttgtacttttgcatagtctcatacacgtatcagaagcctccacctggctaacaggaatttggggctttgggagattttttaatcagggcaaaacctgtactagtaaccacatgtccagactcctcctatgctcccacccagggtcccttgagctgcttcccattcccctagggctgagacccaatatcctctatccctggcctctagtgtaaatgtgtctgtatgttcctgcctatccgtcctaggccctgggtcagaatgggcggagaagccttccatgccctaacctgtgctcttacccagcccccctcctgctcagccccatcaccctcagagagctctgtatgtgtgtgtgcgtgcgtgtgcgcgctgcaggtgcaggcatgttggggcgtgtctcagagcctgaacttcccttccagtcagtgctggaaggaggtgggcaggggaatgatagaaaggaaggagtggattggctccacccactgtgcattctcctgttagtcttttcctcctgacccaggagtaggtggggataggagggcaccctccccatctgctgcttggcagggcatgagcaagtgtccagagcaggtctgtgggggtagtagaagagctgtctctttgggttctccctccagctgggatcaccaactggggttggcccttaggtccatgtgggacattgagatcccagattgcccatagtgggagggctgcaggag

SEQ ID NO: 3500 - DNA, 6 bp, Artificial Sequence
  Synthetic oligonucleotide
gcccag

SEQ ID NO: 3501 - DNA, 65 bp, Artificial Sequence
  Synthetic oligonucleotide
ctggctcgccccccttctccccccctgcagggggaggagtccctgaggggactggggctgggggg

SEQ ID NO: 3502 - DNA, 57 bp, Artificial Sequence
  Synthetic oligonucleotide
ctggcagcaggtgggactgggggtggtccagaccgactggagccagagatggtacgc

SEQ ID NO: 3503 - DNA, 52 bp, Artificial Sequence
  Synthetic oligonucleotide
gcttcaccctgaagaactgggaggccctccactgaagaagctgaaacaagag

SEQ ID NO: 3504 - DNA, 95 bp, Artificial Sequence
  Synthetic oligonucleotide
gttggagaacagagtcaccctgaaatccagcagcctcccccaggccctgagtcctatgtacccccataccgccccagcctggaggaggacagcgc

SEQ ID NO: 3505 - DNA, 38 bp, Artificial Sequence
  Synthetic oligonucleotide
cagcctgtctggggagagtctggatggacatttgcagg

SEQ ID NO: 3506 - DNA, 106 bp, Artificial Sequence
  Synthetic oligonucleotide
gtgcgtggtgccctcacccctgcccagagcgagggggcaaggactctgcctccagggcatctggggttttcccctccctcacacaacacactcccattctctttag

SEQ ID NO: 3507 - DNA, 3135 bp, Homo sapiens
tgtgagacttaggtgcctcaatttgtattgttggtcttttgcacagtttttgatgagtatgaaagaggcactcaagttaaatatgagatcaatatgttagtcttttttctatacgcccatatttagcttgctgtcttattcatctccatggaaatgtagaaactcataagaacaaaagacaatttgaagtcagcttggagatttttatgggaaaaagttatttcttgggcctctgctgattgcaaaatgtggtggttctaggtatgaagcttaaagtcagggaccccatattcattcagcatctcaacttaactcttctattgggtataaatggcccggatagttgtgttcattccacaagtgaaagctagtgaccagccactggtcttctgtttctaaacctagaagatgtttgataaccagaagacaatgcagttggggcccattttttaatttaatctgagccagctttttattagttgattcccaggaagacttaggcatcaattcctttgggactatttcccaggttggatttttttctttttaaaggtctgaagatataaattagcttcaaagcccatcatgtggctagcctttaggtgagaataatgcagaattgatctgcttgtttcttttaggtcagttccttctggcacagtctatgctttgacctaatatgtggtagtggccaagagaggtttatcataacacttctcatttgatgctgtactgacgggtaggtagcaagagggagtagaagcataacttaaaatttaaaatatttagtagcctctagtatgaaacttaaacatcagttccttgtttctttcctctgagagttggtttgtagtaactggcactcaggaacatgagggaaaaaaattacatattgtgaaatggttgagaagacatgaaaatccacttgattttggtgtttccgaatttcaggcaaagaactgttttttaggttgacagggtggaattcagatacttctatgcattaactgtataatcaaaaggaaattgcttgggataggataaagaactgtggtctctttctttaaaatgtgtagatggaacagtgactatgtttttagtgctagcacgtgcatgtcagctgttacaaatatgtctcaaagaatctctctttgcatatctaggcctgtctcctccctcctacacatttccagctcctgctgcagttattcctacagaagctgccatttaccagccctctgtgattttgaatccacgagcactgcagccctccacagcgtactacccagcaggcactcagctcttcatgaactacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagatatattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 3508 - DNA, 1163 bp, Artificial Sequence
  Synthetic oligonucleotide
tgtgagacttaggtgcctcaatttgtattgttggtcttttgcacagtttttgatgagtatgaaagaggcactcaagttaaatatgagatcaatatgttagtcttttttctatacgcccatatttagcttgctgtcttattcatctccatggaaatgtagaaactcataagaacaaaagacaatttgaagtcagcttggagatttttatgggaaaaagttatttcttgggcctctgctgattgcaaaatgtggtggttctaggtatgaagcttaaagtcagggaccccatattcattcagcatctcaacttaactcttctattgggtataaatggcccggatagttgtgttcattccacaagtgaaagctagtgaccagccactggtcttctgtttctaaacctagaagatgtttgataaccagaagacaatgcagttggggcccattttttaatttaatctgagccagctttttattagttgattcccaggaagacttaggcatcaattcctttgggactatttcccaggttggatttttttctttttaaaggtctgaagatataaattagcttcaaagcccatcatgtggctagcctttaggtgagaataatgcagaattgatctgcttgtttcttttaggtcagttccttctggcacagtctatgctttgacctaatatgtggtagtggccaagagaggtttatcataacacttctcatttgatgctgtactgacgggtaggtagcaagagggagtagaagcataacttaaaatttaaaatatttagtagcctctagtatgaaacttaaacatcagttccttgtttctttcctctgagagttggtttgtagtaactggcactcaggaacatgagggaaaaaaattacatattgtgaaatggttgagaagacatgaaaatccacttgattttggtgtttccgaatttcaggcaaagaactgttttttaggttgacagggtggaattcagatacttctatgcattaactgtataatcaaaaggaaattgcttgggataggataaagaactgtggtctctttctttaaaatgtgtagatggaacagtgactatgtttttagtgctagcacgtgcatgtcagctgttacaaatatgtctcaaagaatctctctttgcatatctag

SEQ ID NO: 3509 - DNA, 169 bp, Artificial Sequence
  Synthetic oligonucleotide
gcctgtctcctccctcctacacatttccagctcctgctgcagttattcctacagaagctgccatttaccagccctctgtgattttgaatccacgagcactgcagccctccacagcgtactacccagcaggcactcagctcttcatgaactacacagcgtactatcccag

SEQ ID NO: 3510 - DNA, 151 bp, Artificial Sequence
  Synthetic oligonucleotide
ccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccag

SEQ ID NO: 3511 - DNA, 742 bp, Artificial Sequence
  Synthetic oligonucleotide
tgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagatatattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaat

SEQ ID NO: 3512 - DNA, 800 bp, Artificial Sequence
  Synthetic oligonucleotide
tgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 3513 - DNA, 110 bp, Artificial Sequence
  Synthetic oligonucleotide
tatgcaaccgaggatggacttatacacacaaatgaccaggccaggactctacccaaagaatgggtttgtatttaagggccccagcagttagaacatcctcagaaaagaag

SEQ ID NO: 3514 - DNA, 2675 bp, Homo sapiens
taaaaatacaaaaattagctgggcgtgatggtgcgtgcctataatcccagctactcaggaggctgaggcaggaggtttgaacccgtcaggcagtggttgcagtgagatgagatcgtgccactgtactccagcctgggcaacaaagcaagactcctcaaaaaaaaaaaaaaaaaaaaaaaaaagaatgtgtgtgcatgtctctcgtgggcatgggtccgggtctgtgtctgcagagggccctttctgggggaacagctgtgcatgcgcctgtctttatgcaggtgtctgtgtgcatgtgcgaccatatctatgcctacatggacccgcgtgtgcacatgtgtctgtgtgttccatcgctgcagtcctgtgtggccctacctcagggtgtgtgcatgtgtgtctcttgcttcttccactgtgtctccaagtgtgttcaagggctagtgtatgcatgtgtgcatgagtgtctctcaccccaccttgagctcagccatcctggggtggcaccctacccatacccggccaagtgtttggggagaaaagggctgttggttctaggatgtgccaagcatttgtgcagggcttgacctgaccctcggtctgcccccaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggtgagaggagatcctcggggcagggcaagccatgtgccgtccagggcgctggctgtatgtggacagggagagaggaccactagggctccagtcctggctgcccccagtactgtgtgtctttcagtgggcaatgcccctccgtgggcatggggtgggtgggtatctcccagggcctctcccgagtcacagccaggcttcctgagcatgggggctcacagaacttctcacctgcgcccaggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaactggtgtctgctgg

SEQ ID NO: 3515 - DNA, 1477 bp, Homo sapiens
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgaggtaagtgaatgagccaacatgtgagtacagtgtccctggaggggaggtggaatgtgcagggggcaggggggaaagagccccagcctgggaatggggagaccctggaaatgttccttcctgtgtctgcacctcatcacctcctgggtggaacagtggtgaacggtggggaacggtggtgaatggtggtaaacagtggtgaacggtggtgaacagtgagtggtatatggacccagcctctaagggaacttctgaatctggctattaaggggtgaagtggggccaggcacggtggctcatgcctgtaatcccagcattttgggaggctgatgtgggaggatcgcttgagccgaggagttcaagaccagcctgggcaacatagcaaaatgccccccatgtctataaaaaataaataaaaaaaaaaggccggtcgtggcagctcacgcctataatcccagcactttgggaagccgagatcacctgaggtcaggagctcaagaccagcctgactaacatggagaaaccccatctctactaaaaatacaaaattagctgggcatgatggtgcataacctggaatctcagctactgggaggctgaggcaggaga

SEQ ID NO: 3516 - DNA, 374 bp, Artificial Sequence
  Synthetic oligonucleotide
ccatcctgccattccccttggggctggaaaagaaaggtttctaacttgctttcaaagcgagttcctatcagccccgttgtgggcaaggtggggctgctacccgttctagagggcctgctcagtggagctggggccaagctgggcctctccagtcggctgcgggggcgcacccccgggcgctgggagtccaggcccggttttgcatcaggccctgccgaggtgtttcctcctcctccgtgtggggcagctgctggctgggctgcctgttgagtcagccttcttccctcacggctcttctcccggtccctgaaactcggctgccaggggagctggagccacctgcgaaggtgtcctcccatactggacccctacag

SEQ ID NO: 3517 - DNA, 610 bp, Artificial Sequence
  Synthetic oligonucleotide
taaaaatacaaaaattagctgggcgtgatggtgcgtgcctataatcccagctactcaggaggctgaggcaggaggtttgaacccgtcaggcagtggttgcagtgagatgagatcgtgccactgtactccagcctgggcaacaaagcaagactcctcaaaaaaaaaaaaaaaaaaaaaaaaaagaatgtgtgtgcatgtctctcgtgggcatgggtccgggtctgtgtctgcagagggccctttctgggggaacagctgtgcatgcgcctgtctttatgcaggtgtctgtgtgcatgtgcgaccatatctatgcctacatggacccgcgtgtgcacatgtgtctgtgtgttccatcgctgcagtcctgtgtggccctacctcagggtgtgtgcatgtgtgtctcttgcttcttccactgtgtctccaagtgtgttcaagggctagtgtatgcatgtgtgcatgagtgtctctcaccccaccttgagctcagccatcctggggtggcaccctacccatacccggccaagtgtttggggagaaaagggctgttggttctaggatgtgccaagcatttgtgcagggcttgacctgaccctcggtctgcccccag

SEQ ID NO: 3518 - DNA, 209 bp, Artificial Sequence
  Synthetic oligonucleotide
gaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccag

SEQ ID NO: 3519 - DNA, 149 bp, Artificial Sequence
  Synthetic oligonucleotide
caagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggg

SEQ ID NO: 3520 - DNA, 238 bp, Artificial Sequence
  Synthetic oligonucleotide
gtgagaggagatcctcggggcagggcaagccatgtgccgtccagggcgctggctgtatgtggacagggagagaggaccactagggctccagtcctggctgcccccagtactgtgtgtctttcagtgggcaatgcccctccgtgggcatggggtgggtgggtatctcccagggcctctcccgagtcacagccaggcttcctgagcatgggggctcacagaacttctcacctgcgcccag

SEQ ID NO: 3521 - DNA, 606 bp, Artificial Sequence
  Synthetic oligonucleotide
gtaagtgaatgagccaacatgtgagtacagtgtccctggaggggaggtggaatgtgcagggggcaggggggaaagagccccagcctgggaatggggagaccctggaaatgttccttcctgtgtctgcacctcatcacctcctgggtggaacagtggtgaacggtggggaacggtggtgaatggtggtaaacagtggtgaacggtggtgaacagtgagtggtatatggacccagcctctaagggaacttctgaatctggctattaaggggtgaagtggggccaggcacggtggctcatgcctgtaatcccagcattttgggaggctgatgtgggaggatcgcttgagccgaggagttcaagaccagcctgggcaacatagcaaaatgccccccatgtctataaaaaataaataaaaaaaaaaggccggtcgtggcagctcacgcctataatcccagcactttgggaagccgagatcacctgaggtcaggagctcaagaccagcctgactaacatggagaaaccccatctctactaaaaatacaaaattagctgggcatgatggtgcataacctggaatctcagctactgggaggctgaggcaggaga

SEQ ID NO: 3522 - DNA, 161 bp, Artificial Sequence
  Synthetic oligonucleotide
ctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggaccc

SEQ ID NO: 3523 - DNA, 144 bp, Artificial Sequence
  Synthetic oligonucleotide
gccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgg

SEQ ID NO: 3524 - DNA, 206 bp, Artificial Sequence
  Synthetic oligonucleotide
cttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccg

SEQ ID NO: 3525 - DNA, 156 bp, Artificial Sequence
  Synthetic oligonucleotide
gcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctc

SEQ ID NO: 3526 - DNA, 20 bp, Artificial Sequence
  Synthetic oligonucleotide
ctggaggaggggcgggtcag

SEQ ID NO: 3527 - DNA, 73 bp, Artificial Sequence
  Synthetic oligonucleotide
gagaccaggctccaggccacgacagggaggctgaggctgctgtgaaagagaaggaagaggggccagagcccag

SEQ ID NO: 3528 - DNA, 20 bp, Artificial Sequence
  Synthetic oligonucleotide
gctcaccattgatgaggccc

SEQ ID NO: 3529 - DNA, 26 bp, Artificial Sequence
  Synthetic oligonucleotide
ctcaggagaggctcagggagactgag

SEQ ID NO: 3530 - DNA, 36 bp, Artificial Sequence
  Synthetic oligonucleotide
ggacctgatttcccatcgccttctgtccccctaaag

SEQ ID NO: 3531 - DNA, 37 bp, Artificial Sequence
  Synthetic oligonucleotide
gcttcagatcctgaggaggcgtcccaggcccaggaag

SEQ ID NO: 3532 - DNA, 101 bp, Artificial Sequence
  Synthetic oligonucleotide
atcctggccaaggagaccaacaggtctgtgccgaggaggctgacccggagctggagcccgcgtcggggggagagcaggagccgcggccccagcaagcccag

SEQ ID NO: 3533 - DNA, 114 bp, Artificial Sequence
  Synthetic oligonucleotide
accaaggccgcgtcccagatcctggagaatggggaggaggccccggggcccgacccctctctcgaccgcatgctcagcagcagctcctcggtgtccagccttaactcctccacg

SEQ ID NO: 3534 - DNA, 97 bp, Artificial Sequence
  Synthetic oligonucleotide
ctacgtcaaaagctacctcctcccggataagcagagcaagcgcaagacggcggtgaagaaacggaatctgaatccggttttcaacgagactctccgg

SEQ ID NO: 3535 - DNA, 15 bp, Artificial Sequence
  Synthetic oligonucleotide
tactccgtcccgcag

SEQ ID NO: 3536 - DNA, 79 bp, Artificial Sequence
  Synthetic oligonucleotide
gtcccaccctctcccgacgaccttccgagccgcgggttactcgccctgtccctcaagtacgtccccgccggctccgagg

SEQ ID NO: 3537 - DNA, 75 bp, Artificial Sequence
  Synthetic oligonucleotide
gcgcaggactgcccccgagcggggagctgcacttctgggtgaaggaggctcgggacctcctgccgctgcgggcag

SEQ ID NO: 3538 - DNA, 25 bp, Artificial Sequence
  Synthetic oligonucleotide
gatccctggacacttacgtacaatg

SEQ ID NO: 3539 - DNA, 84 bp, Artificial Sequence
  Synthetic oligonucleotide
tctctggacccccatctcagggcctgcccttggctaaagtcaataaagtctattctaagagcaaaaaaaactggtgtctgctgg

SEQ ID NO: 3540 - DNA, 10963 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3541 - DNA, 11204 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3542 - DNA, 11455 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcaggtaagtttattccttatcttggcgattgtgaatagtgctgcagtccacataggatggctgatacctcttgcataaactgatttctttggcactgaaagtatacttagtagtagaattgttagatgaagtggtagttgtaggtttaatttttggaggaacctcccactggtttctgtagtatgtatactaattaacattctttttttttttggatggagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3543 - DNA, 11219 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagatggagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3544 - DNA, 11205 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttctctctgagattttgcttaagttttggtagatattcttaagttttagtgacctcagtttgggaattaagtaagctaaacattgtgtccttattattagttatataaaactatgctttagactttgttagaaacttctgccccaccttgactgactccttttccatttctggttgtacaaaatgaattcacactttaatgctatggccacctttaaataaagtacagcgtgactaaaaaaaaaa

SEQ ID NO: 3545 - DNA, 10782 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3546 - DNA, 15349 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacagtctgatctcagcactccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3547 - DNA, 15587 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacactttgtcccagcactttaggaatgctgaggtcagaccagccacatctcatgtgcaagattgcccagcagacatcaggtctgagagttccccttttaaaaaaggggacttgcttaaaaaagaagtctggccacgattgtgtagagcagctgtgctgtgctggagattcacttttgagagagttctcctctgagacctgatctttagaggctgggcagtcttgcacatgagatggggctggtctgatctcagcactccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3548 - DNA, 14879 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3549 - DNA, 15300 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacagtctgatctcagcactccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3550 - DNA, 10693 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3551 - DNA, 8863 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3552 - DNA, 8622 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3553 - DNA, 8554 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3554 - DNA, 8197 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3555 - DNA, 9775 bp, Homo sapiens
atttttgcgtttcatgcatgtaatttttgtcacccatataagaaaatatatatcagtgacaaagcatttaattgtcaatgaggtttttcttctagggtgtttgtttattttcctctttgcaaaggtgagcagagattcaagtgacccaaaatatatgctcatcctgtgttttagttaaaaacattttgtggtttatggtcttttgttttgccttcaatttgggggagggggtgttcattttcatacatcgtgtaaaataaggtcctatttctcacttctgcatctgaatatcatttttctcaaaggtactcattctctgccttccacattgcagtgttctttatcaaagtcagttgactgtgtccatatttgtgttgatcatgtttttgttctccctgtttttgtccatagtttatgcaagtatcatatatcagctgtataactacaacttggcagtgtaatttgatattgaggattgtgggtcttcactttgtatttctgaggattcctttagatattcattgcttttgtggttccctgtgatttttagcaatacctatttatttctattaactttttttcacaacataaaggtccataattaggggtacattttcatacatataggttgggtaatgatcaaatcagggtacttaggatctctatttgctcgtccaggcatttttttttttttttttttgtggggagaacattcaaaattctcccttcttgctctagaaaaatatgatattgtttactccagtcaccaggctgaggaggagaacttcagatttattcctttaatgttaagataactttgtttccataatcaatccttccccattccccctctatctcccaaactctggtaaccaatattgtgctttctacttcattaagataaacatcttaagatttcacgagtggtatcatgcagtgtttgtctttctaggcctagctcattacatttaacataatgtgttccaggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3556 - DNA, 9432 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcaggtaagtttattccttatcttggcgattgtgaatagtgctgcagtccacataggatggctgatacctcttgcataaactgatttctttggcactgaaagtatacttagtagtagaattgttagatgaagtggtagttgtaggtttaatttttggaggaacctcccactggtttctgtagtatgtatactaattaacattctttttttttttggatggagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3557 - DNA, 9358 bp, Homo sapiens
attattgacatttattttcattctgcctgctgaattttaacttttcctcaaaaagaaaaacttctttctcatgcaaactatccccatatccctaattaggatgaattattgaagcatcctgggtgatttctgaacactttcaatccttcaattattcaggtctagtttaatggcacctgagaacaattacatactgagaactgtcctaaactgacaaaggcgaccaaagagcttatacaggagcatacctgtaccctcacattggctccaaagtctccagagggaaacggacaggacatgatgaatcagctctttttttactgtattatgcttggaaagattgttatggaaacatagaataaatagatagataaatcaaccttgcctggaaaactggaaaaaggttcaaagaggaggcaaatttagaccaatatgtaccaagaactcattgattcttacgggagtaggttattaccagacagacaagtgaaattcagtaggcagaatgataataaatgtcatttattaaatattaaaaagacaaataccttccctattttagaaataaggtaggcaaaggaactgaggagtggaagttgaaggccagctctgggtgctttgtgaacagagcccagttgacagtgggaagatctgtgctctatgctaaggacatgctctgtaatgacaatccactcggttgcactaagaatttaagagcatttatatgaatatatacaatttaaggaaagataaagagaaaaatttgctatcaactctgtgtagatttggaaaatggtgtcaaaggaacagtttcacctgcatttctttgtctagaaagttttattttattaaaaaatgtagtctacaaacgagcctcaatttttggcaataaactcaaaaatgctacacaaaccatcacagaattcggtttgtccttgcaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3558 - DNA, 9166 bp, Homo sapiens
ggtgtttcacatttccacataaattttggcattgtttctttatatttcttaaaacactatttgtcatatactaaatgtatacaattaaaaggtacaaggaagattttgatacgtgtatatgttgagtaatgataaaatcaggttatttagcatctcttcatctcatatagttattatttttgagtggtaacaacattcagaatctttccttctagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3559 - DNA, 10093 bp, Homo sapiens
ttctctgatgattcctgaggtaaagcaatgatatcttgtctgttggttgctgtaaaccttcttttgagatgcatgttttcatgccccttaccctttcttcattgagtttttgtttttctgatttatttgcttaatgtatttgaggtagatcctggatattagacttcatcagatgcgtatgtgggaacattttctcccattgtgtaggctgtctgtttactgtgttggtaattgcttctgctgtgcagcagctcttttgtatattaggccccacttgtcaataattgttttagttgcacttgcttttggggacttaggcatagccatgctctgccaaatcctctgtcaagaagggtatttccaagttctcttgcaggcttttcatagtttgaggtcttgtgtttacatctttcattcatcttgagttaatttctgtgcagggtgagacacaggggcccactgtttttcttctgcaactggctagcactttatcctggcaccatctattgagaggagggagtcctttctccaaagcttatttttgtggatttttttgaagatcagatggtgttaggggtgtgggtttacatctgggtcctctaatctgttccactgctctgtgtgaaatggggtccctagcttttcaatgaaaattaaaatcgggaagtgtgacacaaccaatgtagtgtggacttctcaggattgctttagaaattcagggtgttttgtggtctgcatgaattttagcattgcatatttacatattttttaaaaggttggccatatagtaaaggtatacaatggggggagttagagtggggcattttggttaatgcagacacagaggaatgttaaaatcaggatatttagagtctctgttatcacaaacagttgttaatttatttgtggtgaaaacatttggaatcttcttttccagattttgtgaaaaagctgtgatgttttgttaacctctggtcacagtgctgtggaacagagaggaacaattcattgctctcatctaagtgtaattttgtacctatttctgatccctgcccatgcccctgcttccttccaatctctggaaaccactgttgtgctctctagatctattgcaataaagccttttattttgggttctacatgagtgagatgtggcaatgtttttctttctctacctggttcaggtcatttaccatgctgtcctccaggttcaacagtatggctccaaaggatgaaatttcattctgattttctggctgaagactattctctttgtgtatgtccaccacagttactttatcccttcatctgtggatgggcaggtaagtttattccttatcttggcgattgtgaatagtgctgcagtccacataggatggctgatacctcttgcataaactgatttctttggcactgaaagtatacttagtagtagaattgttagatgaagtggtagttgtaggtttaatttttggaggaacctcccactggtttctgtagtatgtatactaattaacattctttttttttttggatggagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3560 - DNA, 9181 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3561 - DNA, 9103 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcgctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3562 - DNA, 9190 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3563 - DNA, 9410 bp, Homo sapiens
tgcattccagcctgggtaaccaagcgcgactctgtctcaaaaaaagaaaaaaaaagcaatatactgtgtaatcgttgacagcataattcactattatgtagatcggagagcagaggattctgaatgcatgaacatatcattaacatttcaatacattactcataattactgatgaactaaagagaaaccaagaaattatggtgatagttatattgacctggagaaatgtagacacaaaagaaccgtaagatgagaaatgtgttaacacagtctataagggcatgcaagaataaaaataggggagaaaacaggagagtttttcaagagctttctggtcatgtaagtcaacttgtatcggttaatttttaaaaggtttatttacatgcaataaactgcacatacttcaattgtacattttggtaattcttggcatttgtagctctataaaaccagcaacatattaaaatagcaaacatatccattacctttaccaccaaagttttcttgtgttttttctactcactttttcctgcctatccccccatctcttccacaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3564 - DNA, 8955 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3565 - DNA, 9079 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcgctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3566 - DNA, 8902 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3567 - DNA, 8796 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3568 - DNA, 9070 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3569 - DNA, 9168 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3570 - DNA, 8569 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3571 - DNA, 8843 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3572 - DNA, 8849 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggtcatttaccatgctgtcctccaggttcaacagtatggctccaaaggatgaaatttcattctgattttctggctgaagactattctctttgtgtatgtccaccacagttactttatcccttcatctgtggatgggcagatggagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3573 - DNA, 6183 bp, Homo sapiens
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggcgccactgcactccagcctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3574 - DNA, 4524 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgagttgaaactttcttttgattgagcagtttggaaaccgtctttttgtagaatctgcaagtggatatttggaaccctttgaggcctatgctgaaaaaagaaatatcttcactacatgatgaccaccagcagcagctggggaaaccagcaccctgtggaattccatacggtgcatagaatacatcctcccttcagtcggcttgggtcaacttaggtcatgggccacctggctgatagcagtttccacagaaatgcttcaagatggtataataatccaaatctctttgcatggggcatggtgtggctatctgagaaaaacctggcttttataggaaggagaaagaagaatgcttcttgaggggaagaaaccaacagcagtgtgcctcagggaaatgtcaccagaggagagtgagctgtaatgactattttggcagattatttcttgtggttcttgggttccttggccctgcacagagctaccatttactcatttgacaaatatttgagtggtagactccagggttcaatagtgatcaaaaatgcacagaatttcttccctagtggagcttagaatctaacagaaagagctgacattagtcacaaaattatgtaataagggaaagtgcagcagacccaggtgtgctgcaagagcctgtgaaggcggactgaccccaagacagaggcaggaaaggatgcctccaggaagcagcaattgagccaaaatcagggagaaaactaggcaaagacacagtattcaggaggaggtagaagctggcccatgaggacggtggtgtggagaggtgaaccaatacccaggtccttggatttattgttgagctgctgaatgaaccagggctggctcttgcccaacctctgcacttcttgttttgcaaggttataaatttttttatttaaaagctagtatgagttgggatctgttgcttttctgagaccccgtcctgtgaggtagacagggggcctcactgtactctggggaactaaagatggagaagggttttagagtgcctggagaagaggccctttaacggatcatttaagaagagggtgctactgctagactgcccagattccctttctgtctttgtgaccttggactctctgtgtctgttttccaatctgaaaaacggaataatgatagtatctgcctctgcctgcaagaccctgacctatcagaccaactaccttttcactagaactctcttcttgcactgtaccccaactggaccactcattaaaacttaaaatgggcatattttccttttctagattttgctcaagacatttccctcatcaaaattaaatttggtccatctccccctattggaattaaacccattctccagaaatcagttcaaattttatcagcagaaagcctctctcaattacccccaccttcttttattctttgggccatttctgctatcatttctgtttttcttttttgctacatattggtgtaggtacatacgatctccacttccactcaaatgtgaggttactgcgggcagtccctatggatatagtcatatcccaagagtcctgggcagagggtttccctctttcacccaggctggagtgcagtggtgcaaccagagcttactgcagcctcaacctcctggggtcaaatgatcgtctcagcctttccagtagctggtactaaaagcgggcaccaccatgcttggctaattttcatatttttcatagagacggggttccaccatgtggccttgcttggtctgaaagttctgagctcaagcaacccacctgccttagcctctcaacgtcctggaatgacagcatgagttgccacacctggctgcatgccgaatactttagagttgtttatgcctgacacttccagggcatgcagaactatggtggcattaaccgacacattaaccaactgcctcacttacttttcttttgactcagtttataaattttcttaatttaaattttaatttcaacatgtatacatctttgaaataaataaaataagctctttgaatgtttgacataacgtagaagaaattgacaaatggacatctttacttcattttctgtctcaaaatgtggtacaaatagcctcccctaaagtgatcccaattattacatagccatcttgctgtggctaatgtagaatgtttttgcagtatcacatgcacgaagggcatatccaaaaaacatttgagtgaagataatactagattctagaaagtatctagacacttaagagcaggtggtgatgatgttaattaataataacaatgttgaggggctggcttctgcccttccctaataagcataaagagcatataaactcagcaaat

SEQ ID NO: 3575 - DNA, 6536 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacactttgtcccagcatccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaaggtgagtgtaagttttttccagcttctaagatggcagagaacgatcaccagcctgagccttatttccaggtaagtagctgaattagagttttgtcttaaaatttttccttaatgaataaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatcttccaaattgtggggagcaaggcatctgaaatggctaaaactcctgtggctgcaaaaaataaaaataaaaaaaaatataaaaaaataaacacacacaaaaaatgaaaaacaaaaacaaaaaacacaaaaaagccaaaagaaaaaaccccaaaaaaaaacaaaaaaaggcaaaacaacaacaacaacaacaaaaaaaaa

SEQ ID NO: 3576 - DNA, 6825 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacactttgtcccagcactttaggaatgctgaggtcagaccagccacatctcatgtgcaagattgcccagcagacatcaggtctgagagttccccttttaaaaaaggggacttgcttaaaaaagaagtctggccacgattgtgtagagcagctgtgctgtgctggagattcacttttgagagagttctcctctgagacctgatctttagaggctgggcagtcttgcacatgagatggggctggtctgatctcagcactccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaaggtgagtgtaagttttttccagcttctaagatggcagagaacgatcaccagcctgagccttatttccaggtaagtagctgaattagagttttgtcttaaaatttttccttaatgaataaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatcttccaaattgtggggagcaaggcatctgaaatggctaaaactcctgtggctgcaaaaaataaaaataaaaaaaaatataaaaaaataaacacacacaaaaaatgaaaaacaaaaacaaaaaacacaaaaaagccaaaagaaaaaaccccaaaaaaaaacaaaaaaaggcaaaacaacaacaacaacaacaaaaaaaaa

SEQ ID NO: 3577 - DNA, 6234 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3578 - DNA, 3093 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgagttgaaactttcttttgattgagcagtttggaaaccgtctttttgtagaatctgcaagtggatatttggaaccctttgaggcctatgctgaaaaaagaaatatcttcactacatgatgaccaccagcagcagctggggaaaccagcaccctgtggaattccatacggtgcatagaatacatcctcccttcagtcggcttgggtcaacttaggtcatgggccacctggctgatagcagtttccacagaaatgcttcaagatggtataataatccaaatctctttgcatggggcatggtgtggctatctgagaaaaacctggcttttataggaaggagaaagaagaatgcttcttgaggggaagaaaccaacagcagtgtgcctcagggaaatgtcaccagaggagagtgagctgtaatgactattttggcagattatttcttgtggttcttgggttccttggccctgcacagagctaccatttactcatttgacaaatatttgagtggtagactccagggttcaatagtgatcaaaaatgcacagaatttcttccctagtggagcttagaatctaacagaaagagctgacattagtcacaaaattatgtaataagggaaagtgcagcagacccaggtgtgctgcaagagcctgtgaaggcggactgaccccaagacagaggcaggaaaggatgcctccaggaagcagcaattgagccaaaatcagggagaaaactaggcaaagacacagtattcaggaggaggtagaagctggcccatgaggacggtggtgtggagaggtgaaccaatacccaggtccttggatttattgttgagctgctgaatgaaccagggctggctcttgcccaacctctgcacttcttgttttgcaaggttataaatttttttatttaaaagct

SEQ ID NO: 3579 - DNA, 3554 bp, Homo sapiens
ggagtagatagagcttggagcaagaaggagctccaagcaagatggagcttgcagcaggtgcttctcagtgtaagatggagctcagagaagatgatgctcagagcaaggttgagctcagggtgattggcactccaaacattgctctgagcccattggagctctgagcaagaaggtgggaagtgagcaagaaggtgaagaagtgatacattcccacagaacattacaagtttagcggaagctattattgaatgtaaagagaagaatgccccagaattctatgtggattgtcgggacaatactcatttctgtaatcaggcctactttcttttaaaaagtttatcatatcaaacctcacaaggacaaccagaactctgcgatatccactctacaaacctcagacccctacagtgtagtaaaggtggcagccaagatagaaagacagaaacacactgtttgatgaccagtctttggaagttgagacagcaaatgtggatttactcagattattttcctgttaacacctccaggtgttattttgatggtactttgcattgggctgatgacacaatggggaaacataaactgctgacgctggacttcagcagtacagtaacagccatgtgcaaggccattgaaaaagtaaagactggtggttacattgccacgtgtttttctgcatggcatcatcatcttaactatggactttatgtgctttcacagcaagatgtttctagtatttagaaatggaccttatgcattgtatacttcccaagagcttggaaagctctcacccaggtactaccaaatgccagacatctctctatgtgggccattttctgccacagccagaattcattctgggtgacatgctgttcttggctgctaaggaagtgatgtgggggagccaggtgtctctcgctgtctgtgagtctatgggaaaaaggagaatactgaaaggcactaagtttactgccacgtttagaggagctttgtcaaggcaacacaagagtgttgtagtcctttgtggccaacaccaacctgagtttttacagcagttgttgcataatgatcacagtcacattcaagttcactttctaaatcttaggttctacaaaaactctgtctgataatgtcctatagacctttcggtagctaaaatcaatgagtttgaaaaataatttgaatttggcttgctcaccttttcagcagaatgcacttgtgagtcctgctctgtcattgtattttacatgtgtggctgtccctcttgctgtgttggaagtcagtgttccagaatgttaacttctacaaatacctatgtatagagcaaagagaaaactcttcaagtcaaaagagtgtatattatttcagggcagctctctagccttggatttgaaactatagtatttgttacacagagagaagatggttcttttttgtattttatttttaatgtttgtgggtacatagtatttatggagtacatgagatgttttgacaagggcattcaatgtgaaaaaaaacacatcctagagaatggggtatcccctcagtgattctttgagttacaaatattccaattacactctttatgttattttcaaatatatgattaagttattattgactatagtcacctgggtttgctatcaaatagtaggtttttattatatattatttcttttttgttttttgtatccattaacaattcctgcctccccctcactctctcactacccttcccaagctctggtaatcatccttctactctctatgtccatgagtttaattgtttttatttttagatcccggaaataagcgagaacacatgatgtttgtatttctgtgcctggcttatttttcttgacataatcatcttcagttccatccatgttgttgcaaatgacaggctttcatttttatggctgaatagtactccactgtgtatatgtaccacattttcttcattcatctgttgatggacacttaggttgctttcaaatattagtaattgtaaacagtgctgcagcaaacctaggagtgcagaaatctctttgatatactcatttcctttcttttgggtatataccaagcagtgggatttttggatcatatggtagtatatctgttttttttcaggaaactccaaactgtccaaggagatagttctgttgtgattacttcattgagaaatttaacttatgagcagttgaaaggaatgcaagttgctgcaaaatcagaatgaagagtgcaaaacgaccaagctacaatgttttgtcattattcactctgatgtgaaaaaggcagtgaatttaatagaaaataacttcgtagagcaaaatctcaggtgtgtttttttagtgccgcagtcttggatgatgggttcctagaagctctcaacatctcttcttaattggagaaagtgttaagccccaaagtagctggagcagtacatcttcaatttttgacaagaaagcaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatggaagacttttatgtggtttttactcactcttcatctcagacatcaacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactgtattacctaaggctaaacctaaaatttttaagcaaaattagaaaaatagtcttcactcatcaaaaaataaagtttgttacatttagtattttcccaa

SEQ ID NO: 3580 - DNA, 3647 bp, Homo sapiens
ggagtagatagagcttggagcaagaaggagctccaagcaagatggagcttgcagcaggtgcttctcagtgtaagatggagctcagagaagatgatgctcagagcaaggttgagctcagggtgattggcactccaaacattgctctgagcccattggagctctgagcaagaaggtgggaagtgagcaagaaggtgaagaagtgatacattcccacagaacattacaagtttagcggaagctattattgaatgtaaagagaagaatgccccagaattctatgtggattgtcgggacaatactcatttctgtaatcaggcctactttcttttaaaaagtttatcatatcaaacctcacaaggacaaccagaactctgcgatatccactctacaaacctcagacccctacagtgtagtaaaggtggcagccaagatagaaagacagaaacacactgtttgatgaccagtctttggaagttgagacagcaaatgtggatttactcagattattttcctgttaacacctccaggtgttattttgatggtactttgcattgggctgatgacacaatggggaaacataaactgctgacgctggacttcagcagtacagtaacagccatgtgcaaggccattgaaaaagtaaagactggtggttacattgccacgtgtttttctgcatggcatcatcatcttaactatggactttatgtgctttcacagcaagatgtttctagtatttagaaatggaccttatgcattgtatacttcccaagagcttggaaagctctcacccaggtactaccaaatgccagacatctctctatgtgggccattttctgccacagccagaattcattctgggtgacatgctgttcttggctgctaaggaagtgatgtgggggagccaggtgtctctcgctgtctgtgagtctatgggaaaaaggagaatactgaaaggcactaagtttactgccacgtttagaggagctttgtcaaggcaacacaagagtgttgtagtcctttgtggccaacaccaacctgagtttttacagcagttgttgcataatgatcacagtcacattcaagttcactttctaaatcttaggttctacaaaaactctgtctgataatgtcctatagacctttcggtagctaaaatcaatgagtttgaaaaataatttgaatttggcttgctcaccttttcagcagaatgcacttgtgagtcctgctctgtcattgtattttacatgtgtggctgtccctcttgctgtgttggaagtcagtgttccagaatgttaacttctacaaatacctatgtatagagcaaagagaaaactcttcaagtcaaaagagtgtatattatttcagggcagctctctagccttggatttgaaactatagtatttgttacacagagagaagatggttcttttttgtattttatttttaatgtttgtgggtacatagtatttatggagtacatgagatgttttgacaagggcattcaatgtgaaaaaaaacacatcctagagaatggggtatcccctcagtgattctttgagttacaaatattccaattacactctttatgttattttcaaatatatgattaagttattattgactatagtcacctgggtttgctatcaaatagtaggtttttattatatattatttcttttttgttttttgtatccattaacaattcctgcctccccctcactctctcactacccttcccaagctctggtaatcatccttctactctctatgtccatgagtttaattgtttttatttttagatcccggaaataagcgagaacacatgatgtttgtatttctgtgcctggcttatttttcttgacataatcatcttcagttccatccatgttgttgcaaatgacaggctttcatttttatggctgaatagtactccactgtgtatatgtaccacattttcttcattcatctgttgatggacacttaggttgctttcaaatattagtaattgtaaacagtgctgcagcaaacctaggagtgcagaaatctctttgatatactcatttcctttcttttgggtatataccaagcagtgggatttttggatcatatggtagtatatctgttttttttcaggaaactccaaactgtccaaggagatagttctgttgtgattacttcattgagaaatttaacttatgagcagttgaaaggaatgcaagttgctgcaaaatcagaatgaagagtgcaaaacgaccaagctacaatgttttgtcattattcactctgatgtgaaaaaggcagtgaatttaatagaaaataacttcgtagagcaaaatctcaggtgtgtttttttagtgccgcagtcttggatgatgggttcctagaagctctcaacatctcttcttaattggagaaagtgttaagccccaaagtagctggagcagtacatcttcaatttttgacaagaaagcaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatggaagacttttatgtggtttttactcactcttcatctcagacatcaacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactgtattacctaaggctaaacctaaaatttttaagcaaaattagaaaaatagtcttcactcatcaaaaaataaagtttgttacatttagtattttcccaataaaattggtcgttcttggttttttatttggagagtctgtgcaaaatgtcactaaaaataaattagcactagaaattatttctaaataccaaa

SEQ ID NO: 3581 - DNA, 2912 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaaatgtggatgaagaattgaatgaatgaatgaatatgagagaaaatgaataaatggttcagatcctgggctggaaggctgtgtatgaggatggtgggtagaggagggtctgtttttcttgcctttaagtcactaattgtcactttggggcaggagcacaggctttgaatgcagaccgactggactttaattctggctttactagttgtgattgtgtgaccttgtgcaagttacttaaaccctctgtgcctgtttctttatctgtaaaatggagataataagatgtcaaaggactgtggtaagaattaaatgctttaaaaaaatcgcagtttgtattaagtcctcaatagattgggtttagcatcatgagtgcatgtgtttctggagcaatgctcatcttgggctgcatggtgcctacacagagaaagactctggcctcttctcatccacatgtatctgtcttatgcctggttcccattcccagatccttggaagatccatattgctgaaacggtgaagggtgatgggcacctcaggacaactaagctgctccccaaacatctccccccccaaaaaaa

SEQ ID NO: 3582 - DNA, 2450 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttccta

SEQ ID NO: 3583 - DNA, 3693 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttctctctgagattttgcttaagttttggtagatattcttaagttttagtgacctcagtttgggaattaagtaagctaaacattgtgtccttattattagttatataaaactatgctttagactttgttagaaacttctgccccaccttgactgactccttttccatttctggttgtacaaaatgaattcacactttaatgctatggccacctttaaataaagtacagcgtgactaaaaaaaaaa

SEQ ID NO: 3584 - DNA, 2629 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttcctaaaatatatggggtgtgttttttgttctcacttctgttagtcctttggtccctagctccagtttttttgtaatttcttttgcaacctaatatgagtcccatttagtaagtattacatatactaggaaatgatgtatattcagcatttgttgtgattttaaaatcttttataaacacgtaa

SEQ ID NO: 3585 - DNA, 2849 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgagttgaaactttcttttgattgagcagtttggaaaccgtctttttgtagaatctgcaagtggatatttggaaccctttgaggcctatgctgaaaaaagaaatatcttcactacatgatgaccaccagcagcagctggggaaaccagcaccctgtggaattccatacggtgcatagaatacatcctcccttcagtcggcttgggtcaacttaggtcatgggccacctggctgatagcagtttccacagaaatgcttcaagatggaatctctggacactccaagggttgatcctctcatggaagaccagtggggaggaggctgcgggaaaggtcaggcactgtgcacttccctgacagctgcaaatggttgtttccaagcccactggtcactacaaataagaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttccta

SEQ ID NO: 3586 - DNA, 3451 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttcatctgtgttgctctaaatgacactgcttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctcctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 3587 - DNA, 2484 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggttttggctgttgcaagtaaagctgctatgaagattcatgtaaaatcctctgaatgggcatatgctcttagttttcatctctaatagaagtggaatagacagctatcatgtctgtaatatgcaaacacaaaggctgacaaaactgatttttaaagtggaaactccactggataaccttgactccagcctggcttttgagagtatctcctatgtttgtgcaatgattggtcctggggtagccacatgacccaaggaggaccatgtttaaacttctgagttttcatcgagattaacatgcatttgttgaaa

SEQ ID NO: 3588 - DNA, 2642 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggtaaccactgatccacttccagtcactatccatgagtttttatttccaaatacatgaaatcatatgaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaaatgtggatgaagaattgaatgaatgaatgaatatgagagaaaatgaataaatggttcagatcctgggctggaaggctgtgtatgaggatggtgggtagaggagggtctgtttttcttgcctttaagtcactaattgtcactttggggcaggagcacaggctttgaatgcagaccgactggactttaattctggctttactagttgtgattgtgtgaccttgtgcaagttacttaaaccctctgtgcctgtttctttatctgtaaaatggagataataagatgtcaaaggactgtggtaagaattaaatgctttaaaaaaatcgcagtttgtattaagtcctcaatagattgggtttagcatcatgagtgcatgtgtttctggagcaatgctcatcttgggctgcatggtgcctacacagagaaagactctggcctcttctcatccacatgtatctgtcttatgcctggttcccattcccagatccttggaagatccatattgctgaaacggtgaagggtgatgggcacctcaggacaactaagctgctccccaaacatctccccccccaaaaaaa

SEQ ID NO: 3589 - DNA, 2180 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggtaaccactgatccacttccagtcactatccatgagtttttatttccaaatacatgaaatcatatgaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttccta

SEQ ID NO: 3590 - DNA, 6566 bp, Homo sapiens
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcagcaagtatagtcagccttctacttgagcaaaacattgatgtatcttctcaagatctatctggacagacggccagagagtatgctgtttctagtcgtcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacagtctgatctcagcactccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaagagtaatgattctcactgtggagtcatttgattattaagacccgttggcataagattacatcctctgactataaaaatcctggaagaaaacctaggaaatattcgtctggacattgcacttggcaatgaatttatgggtaaccactgatccacttccagtcactatccatgagtttttatttccaaatacatgaaatcatatgaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttccta

SEQ ID NO: 3591 - DNA, 2442 bp, Homo sapiens
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcacgttttttttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggtaaccactgatccacttccagtcactatccatgagtttttatttccaaatacatgaaatcatatgagttgaaactttcttttgattgagcagtttggaaaccgtctttttgtagaatctgcaagtggatatttggaaccctttgaggcctatgctgaaaaaagaaatatcttcactacatgatgaccaccagcagcagctggggaaaccagcaccctgtggaattccatacggtgcatagaatacatcctcccttcagtcggcttgggtcaacttaggtcatgggccacctggctgatagcagtttccacagaaatgcttcaagatgaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttccta

SEQ ID NO: 3592 - DNA, 473 bp, Artificial Sequence
  Synthetic oligonucleotide
tatgaactgattatttagtaacaatctgggaaaattaaatataaatagattttaaataaatgttggaaaattttttcagatgggcagtgtgagttttaatagcaatttttgttgcatgttggaggttgaactttcagtaaaacatgaaactaaagaaatattttacatgcaaattcttgctttatacgcaatttatcttagggttgaggatatagaaacaaaagatacagcccctgccctcaaggagctctttgtttagatgggaaaaatattaccatccaataataccatatcaaatgctgggttagaagcaaagagccttggaagcagtaaatgtttaaagtgagtttttgagatgagtagagttactgtggtgaggcagagaaggggtgtttccaagggaaggagcagcgtgtgggaaagcacagaagagtgagaaggaagcgactacattttattgactttctatgcat

SEQ ID NO: 3593 - DNA, 138 bp, Artificial Sequence
  Synthetic oligonucleotide
aactgctctcatacttgctgtatgttgtggatcagcaagtatagtcagccttctacttgagcaaaacattgatgtatcttctcaagatctatctggacagacggccagagagtatgctgtttctagtcgtcataatgt

SEQ ID NO: 3594 - DNA, 167 bp, Artificial Sequence
  Synthetic oligonucleotide
gttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacag

SEQ ID NO: 3595 - DNA, 2916 bp, Artificial Sequence
  Synthetic oligonucleotide
ctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgatgatcttttaaagggtctacaactgaatgagctcaccatggatgatgatactgccgtgctcgtcattgacaacggctctggcacgtgcaaggccggctttgcaggtgacgatgccccccgggctgtcttcccttccatcgtggggtgccccaggcaccagagcatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactggctacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctagcgcctagcacgatgaagatcaagattgttgctcctcccaagcgcaagtactccgtgtgggtcggtggctccatcctggcctcgctgtccaccttccagcagatgtggatcagcaagcaggagtatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccagggg

SEQ ID NO: 3596 - DNA, 544 bp, Artificial Sequence
  Synthetic oligonucleotide
ctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaagccaatccatctcccacag

SEQ ID NO: 3597 - DNA, 227 bp, Artificial Sequence
  Synthetic oligonucleotide
gtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagaca

SEQ ID NO: 3598 - DNA, 134 bp, Artificial Sequence
  Synthetic oligonucleotide
ctttaggaatgctgaggtcagaccagccacatctcatgtgcaagattgcccagcagacatcaggtctgagagttccccttttaaaaaaggggacttgcttaaaaaagaagtctggccacgattgtgtagagcag

SEQ ID NO: 3599 - DNA, 228 bp, Artificial Sequence
  Synthetic oligonucleotide
tccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacag

SEQ ID NO: 3600 - DNA, 919 bp, Artificial Sequence
  Synthetic oligonucleotide
gtggattttgctttacttgcactgacagcacacaggagggcagcacacaccccaacccacatcaactgccattaaagaaaagaaatttcagcccattatttcatgtccagcaaaattaggcatcataagtgaaggagaaatgagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaag

SEQ ID NO: 3601 - DNA, 498 bp, Artificial Sequence
  Synthetic oligonucleotide
gtgagtgtaagttttttccagcttctaagatggcagagaacgatcaccagcctgagccttatttccaggtaagtagctgaattagagttttgtcttaaaatttttccttaatgaataaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatcttccaaattgtggggagcaaggcatctgaaatggctaaaactcctgtggctgcaaaaaataaaaataaaaaaaaatataaaaaaataaacacacacaaaaaatgaaaaacaaaaacaaaaaacacaaaaaagccaaaagaaaaaaccccaaaaaaaaacaaaaaaaggcaaaacaacaacaacaacaacaaaaaaaaa

SEQ ID NO: 3602 - DNA, 636 bp, Artificial Sequence
  Synthetic oligonucleotide
gtctttgcacatgagatgggtctcctgaatacaggacaacaatgggtctttactctttatccaacttgccagtctgtgtcttttaactggggcatttagcccatttacatttaagtttagtattgttacatgtgaaatttatcctgtcatgatgttgctagctttttatttttcccattagtttgcagtttctttatagtgtcaatggtctttacaattcgatatgtttttgtagtggctggtactggtttttcctttctacgtttagtgtctccttcaggagctcttgtaacacaagaatgtggatttatttcttgtaaggtaaatatgtggatttatttcttgggactgtattctatggcctttaccccaagaatcattactttttaaaatgcaattcaaattagcataaaacatttacagcctatggaaaggcttgtggcattagaatccttatttataggattattttgtgtttttttgagatatggtctttgtcatcgaggcagaagtgccgtggtttgatcataattcaccacagccctgaactcttgagtccaagccatccttttgccttaatctcccaaccagttggatctacaagcataaggcatcatgcgtggctaattttttcac

SEQ ID NO: 3603 - DNA, 1061 bp, Artificial Sequence
  Synthetic oligonucleotide
tttttttttggtcgaaattattggtatcactatgttgctctggctgatctcaaatgtttgacctcaagggatctttctgccacagcctcctaaagtgctaggattatatgcatgatacaccatgcctattgtagagtattacattattttcaaagtcttattgtaagagccatttattgcctttggcctaaataactcaatataatatctctgaaacttttttttgacaaattttggggcgtgatgatgagagaagggggtttgaaactttctaataagagttaacttagagccatttaagaaaggaaaaaacacaaattatcagaaaaacaacagtaagatcaagtgcaaaagttctgtggcaaagatgatgagagtaaagaatatatgtttgtgactcatggtggcttttactttgttcttgaatttctgagtacgggttaacatttaaagaatctacattatagataacattttattgcaagtaaatgtatttcaaaatttgttattggttttgtatgagattattctcagcctacttcattatcaagctatattattttattaatgtagttcgatgatcttacagcaaagctgaaagctgtatcttcaaaatatgtctatttgactaaaaagaagttattcaacaggagttattatctatgaaaaaaatacaacaggaatataaaaaacttgaagaggataaaaagatgttggaaaaagtaatattaaatcttaaaaaacatatggaaagtacacattggtgaagacacattggtgaagtacaaaaatataaattggatctagaagaaagggcaatgcaggcaatggaaaaattagtagaaatccctttaaaggttagtttgtaaaatcaggtaagtttatttataatttgctttcatttatttcactgcaaattatattttggatatatatatatattgtgcttcctctgcctgtcttacagcaatttgccttgcagagttctaggaaaaaggtggcatgtgtttttactttcaaatatttaaatttccatcattctaacaaaatcaatttttcag

SEQ ID NO: 3604 - DNA, 136 bp, Artificial Sequence
  Synthetic oligonucleotide
agtaatgattctcactgtggagtcatttgattattaagacccgttggcataagattacatcctctgactataaaaatcctggaagaaaacctaggaaatattcgtctggacattgcacttggcaatgaatttatgg

SEQ ID NO: 3605 - DNA, 270 bp, Artificial Sequence
  Synthetic oligonucleotide
gcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcag

SEQ ID NO: 3606 - DNA, 556 bp, Artificial Sequence
  Synthetic oligonucleotide
tgcattccagcctgggtaaccaagcgcgactctgtctcaaaaaaagaaaaaaaaagcaatatactgtgtaatcgttgacagcataattcactattatgtagatcggagagcagaggattctgaatgcatgaacatatcattaacatttcaatacattactcataattactgatgaactaaagagaaaccaagaaattatggtgatagttatattgacctggagaaatgtagacacaaaagaaccgtaagatgagaaatgtgttaacacagtctataagggcatgcaagaataaaaataggggagaaaacaggagagtttttcaagagctttctggtcatgtaagtcaacttgtatcggttaatttttaaaaggtttatttacatgcaataaactgcacatacttcaattgtacattttggtaattcttggcatttgtagctctataaaaccagcaacatattaaaatagcaaacatatccattacctttaccaccaaagttttcttgtgttttttctactcactttttcctgcctatccccccatctcttccacag

SEQ ID NO: 3607 - DNA, 309 bp, Artificial Sequence
  Synthetic oligonucleotide
gttttggctgttgcaagtaaagctgctatgaagattcatgtaaaatcctctgaatgggcatatgctcttagttttcatctctaatagaagtggaatagacagctatcatgtctgtaatatgcaaacacaaaggctgacaaaactgatttttaaagtggaaactccactggataaccttgactccagcctggcttttgagagtatctcctatgtttgtgcaatgattggtcctggggtagccacatgacccaaggaggaccatgtttaaacttctgagttttcatcgagattaacatgcatttgttgaaa

SEQ ID NO: 3608 - DNA, 262 bp, Artificial Sequence
  Synthetic oligonucleotide
agttgaaactttcttttgattgagcagtttggaaaccgtctttttgtagaatctgcaagtggatatttggaaccctttgaggcctatgctgaaaaaagaaatatcttcactacatgatgaccaccagcagcagctggggaaaccagcaccctgtggaattccatacggtgcatagaatacatcctcccttcagtcggcttgggtcaacttaggtcatgggccacctggctgatagcagtttccacagaaatgcttcaagatg

SEQ ID NO: 3609 - DNA, 2087 bp, Artificial Sequence
  Synthetic oligonucleotide
gtataataatccaaatctctttgcatggggcatggtgtggctatctgagaaaaacctggcttttataggaaggagaaagaagaatgcttcttgaggggaagaaaccaacagcagtgtgcctcagggaaatgtcaccagaggagagtgagctgtaatgactattttggcagattatttcttgtggttcttgggttccttggccctgcacagagctaccatttactcatttgacaaatatttgagtggtagactccagggttcaatagtgatcaaaaatgcacagaatttcttccctagtggagcttagaatctaacagaaagagctgacattagtcacaaaattatgtaataagggaaagtgcagcagacccaggtgtgctgcaagagcctgtgaaggcggactgaccccaagacagaggcaggaaaggatgcctccaggaagcagcaattgagccaaaatcagggagaaaactaggcaaagacacagtattcaggaggaggtagaagctggcccatgaggacggtggtgtggagaggtgaaccaatacccaggtccttggatttattgttgagctgctgaatgaaccagggctggctcttgcccaacctctgcacttcttgttttgcaaggttataaatttttttatttaaaagctagtatgagttgggatctgttgcttttctgagaccccgtcctgtgaggtagacagggggcctcactgtactctggggaactaaagatggagaagggttttagagtgcctggagaagaggccctttaacggatcatttaagaagagggtgctactgctagactgcccagattccctttctgtctttgtgaccttggactctctgtgtctgttttccaatctgaaaaacggaataatgatagtatctgcctctgcctgcaagaccctgacctatcagaccaactaccttttcactagaactctcttcttgcactgtaccccaactggaccactcattaaaacttaaaatgggcatattttccttttctagattttgctcaagacatttccctcatcaaaattaaatttggtccatctccccctattggaattaaacccattctccagaaatcagttcaaattttatcagcagaaagcctctctcaattacccccaccttcttttattctttgggccatttctgctatcatttctgtttttcttttttgctacatattggtgtaggtacatacgatctccacttccactcaaatgtgaggttactgcgggcagtccctatggatatagtcatatcccaagagtcctgggcagagggtttccctctttcacccaggctggagtgcagtggtgcaaccagagcttactgcagcctcaacctcctggggtcaaatgatcgtctcagcctttccagtagctggtactaaaagcgggcaccaccatgcttggctaattttcatatttttcatagagacggggttccaccatgtggccttgcttggtctgaaagttctgagctcaagcaacccacctgccttagcctctcaacgtcctggaatgacagcatgagttgccacacctggctgcatgccgaatactttagagttgtttatgcctgacacttccagggcatgcagaactatggtggcattaaccgacacattaaccaactgcctcacttacttttcttttgactcagtttataaattttcttaatttaaattttaatttcaacatgtatacatctttgaaataaataaaataagctctttgaatgtttgacataacgtagaagaaattgacaaatggacatctttacttcattttctgtctcaaaatgtggtacaaatagcctcccctaaagtgatcccaattattacatagccatcttgctgtggctaatgtagaatgtttttgcagtatcacatgcacgaagggcatatccaaaaaacatttgagtgaagataatactagattctagaaagtatctagacacttaagagcaggtggtgatgatgttaattaataataacaatgttgaggggctggcttctgcccttccctaataagcataaagagcatataaactcagcaaat

SEQ ID NO: 3610 - DNA, 737 bp, Artificial Sequence
  Synthetic oligonucleotide
aaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaaatgtggatgaagaattgaatgaatgaatgaatatgagagaaaatgaataaatggttcagatcctgggctggaaggctgtgtatgaggatggtgggtagaggagggtctgtttttcttgcctttaagtcactaattgtcactttggggcaggagcacaggctttgaatgcagaccgactggactttaattctggctttactagttgtgattgtgtgaccttgtgcaagttacttaaaccctctgtgcctgtttctttatctgtaaaatggagataataagatgtcaaaggactgtggtaagaattaaatgctttaaaaaaatcgcagtttgtattaagtcctcaatagattgggtttagcatcatgagtgcatgtgtttctggagcaatgctcatcttgggctgcatggtgcctacacagagaaagactctggcctcttctcatccacatgtatctgtcttatgcctggttcccattcccagatccttggaagatccatattgctgaaacggtgaagggtgatgggcacctcaggacaactaagctgctccccaaacatctccccccccaaaaaaa

SEQ ID NO: 3611 - DNA, 137 bp, Artificial Sequence
  Synthetic oligonucleotide
gaatctctggacactccaagggttgatcctctcatggaagaccagtggggaggaggctgcgggaaaggtcaggcactgtgcacttccctgacagctgcaaatggttgtttccaagcccactggtcactacaaataag

SEQ ID NO: 3612 - DNA, 302 bp, Artificial Sequence
  Synthetic oligonucleotide
ttgggggtcatcctcctccatccaggacctgaggggtgtccttttctgcgcttccttggatggcagtctttcccttcatgtttatagtgacttaccattaaatcactgtgccgttttttcctaaaatatatggggtgtgttttttgttctcacttctgttagtcctttggtccctagctccagtttttttgtaatttcttttgcaacctaatatgagtcccatttagtaagtattacatatactaggaaatgatgtatattcagcatttgttgtgattttaaaatcttttataaacacgtaa

SEQ ID NO: 3613 - DNA, 152 bp, Artificial Sequence
  Synthetic oligonucleotide
cacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcg

SEQ ID NO: 3614 - DNA, 987 bp, Artificial Sequence
  Synthetic oligonucleotide
atttttgcgtttcatgcatgtaatttttgtcacccatataagaaaatatatatcagtgacaaagcatttaattgtcaatgaggtttttcttctagggtgtttgtttattttcctctttgcaaaggtgagcagagattcaagtgacccaaaatatatgctcatcctgtgttttagttaaaaacattttgtggtttatggtcttttgttttgccttcaatttgggggagggggtgttcattttcatacatcgtgtaaaataaggtcctatttctcacttctgcatctgaatatcatttttctcaaaggtactcattctctgccttccacattgcagtgttctttatcaaagtcagttgactgtgtccatatttgtgttgatcatgtttttgttctccctgtttttgtccatagtttatgcaagtatcatatatcagctgtataactacaacttggcagtgtaatttgatattgaggattgtgggtcttcactttgtatttctgaggattcctttagatattcattgcttttgtggttccctgtgatttttagcaatacctatttatttctattaactttttttcacaacataaaggtccataattaggggtacattttcatacatataggttgggtaatgatcaaatcagggtacttaggatctctatttgctcgtccaggcatttttttttttttttttttgtggggagaacattcaaaattctcccttcttgctctagaaaaatatgatattgtttactccagtcaccaggctgaggaggagaacttcagatttattcctttaatgttaagataactttgtttccataatcaatccttccccattccccctctatctcccaaactctggtaaccaatattgtgctttctacttcattaagataaacatcttaagatttcacgagtggtatcatgcagtgtttgtctttctaggcctagctcattacatttaacataatgtgttccag

SEQ ID NO: 3615 - DNA, 215 bp, Artificial Sequence
  Synthetic oligonucleotide
ggtgtttcacatttccacataaattttggcattgtttctttatatttcttaaaacactatttgtcatatactaaatgtatacaattaaaaggtacaaggaagattttgatacgtgtatatgttgagtaatgataaaatcaggttatttagcatctcttcatctcatatagttattatttttgagtggtaacaacattcagaatctttccttctag

SEQ ID NO: 3616 - DNA, 1184 bp, Artificial Sequence
  Synthetic oligonucleotide
ttctctgatgattcctgaggtaaagcaatgatatcttgtctgttggttgctgtaaaccttcttttgagatgcatgttttcatgccccttaccctttcttcattgagtttttgtttttctgatttatttgcttaatgtatttgaggtagatcctggatattagacttcatcagatgcgtatgtgggaacattttctcccattgtgtaggctgtctgtttactgtgttggtaattgcttctgctgtgcagcagctcttttgtatattaggccccacttgtcaataattgttttagttgcacttgcttttggggacttaggcatagccatgctctgccaaatcctctgtcaagaagggtatttccaagttctcttgcaggcttttcatagtttgaggtcttgtgtttacatctttcattcatcttgagttaatttctgtgcagggtgagacacaggggcccactgtttttcttctgcaactggctagcactttatcctggcaccatctattgagaggagggagtcctttctccaaagcttatttttgtggatttttttgaagatcagatggtgttaggggtgtgggtttacatctgggtcctctaatctgttccactgctctgtgtgaaatggggtccctagcttttcaatgaaaattaaaatcgggaagtgtgacacaaccaatgtagtgtggacttctcaggattgctttagaaattcagggtgttttgtggtctgcatgaattttagcattgcatatttacatattttttaaaaggttggccatatagtaaaggtatacaatggggggagttagagtggggcattttggttaatgcagacacagaggaatgttaaaatcaggatatttagagtctctgttatcacaaacagttgttaatttatttgtggtgaaaacatttggaatcttcttttccagattttgtgaaaaagctgtgatgttttgttaacctctggtcacagtgctgtggaacagagaggaacaattcattgctctcatctaagtgtaattttgtacctatttctgatccctgcccatgcccctgcttccttccaatctctggaaaccactgttgtgctctctagatctattgcaataaagccttttattttgggttctacatgagtgagatgtggcaatgtttttctttctctacctggttcag

SEQ ID NO: 3617 - DNA, 212 bp, Artificial Sequence
  Synthetic oligonucleotide
gtaagtttattccttatcttggcgattgtgaatagtgctgcagtccacataggatggctgatacctcttgcataaactgatttctttggcactgaaagtatacttagtagtagaattgttagatgaagtggtagttgtaggtttaatttttggaggaacctcccactggtttctgtagtatgtatactaattaacattctttttttttttgg

SEQ ID NO: 3618 - DNA, 136 bp, Artificial Sequence
  Synthetic oligonucleotide
tctcgctgtattgcccaggctggagtgcagtggcatgatctcagctcactgcaagctctgcttcctgggttcacgccattctcctgcctcagcctcctgagtagctgggattacaggcacccgccaccacgcccag

SEQ ID NO: 3619 - DNA, 2136 bp, Artificial Sequence
  Synthetic oligonucleotide
ggagtagatagagcttggagcaagaaggagctccaagcaagatggagcttgcagcaggtgcttctcagtgtaagatggagctcagagaagatgatgctcagagcaaggttgagctcagggtgattggcactccaaacattgctctgagcccattggagctctgagcaagaaggtgggaagtgagcaagaaggtgaagaagtgatacattcccacagaacattacaagtttagcggaagctattattgaatgtaaagagaagaatgccccagaattctatgtggattgtcgggacaatactcatttctgtaatcaggcctactttcttttaaaaagtttatcatatcaaacctcacaaggacaaccagaactctgcgatatccactctacaaacctcagacccctacagtgtagtaaaggtggcagccaagatagaaagacagaaacacactgtttgatgaccagtctttggaagttgagacagcaaatgtggatttactcagattattttcctgttaacacctccaggtgttattttgatggtactttgcattgggctgatgacacaatggggaaacataaactgctgacgctggacttcagcagtacagtaacagccatgtgcaaggccattgaaaaagtaaagactggtggttacattgccacgtgtttttctgcatggcatcatcatcttaactatggactttatgtgctttcacagcaagatgtttctagtatttagaaatggaccttatgcattgtatacttcccaagagcttggaaagctctcacccaggtactaccaaatgccagacatctctctatgtgggccattttctgccacagccagaattcattctgggtgacatgctgttcttggctgctaaggaagtgatgtgggggagccaggtgtctctcgctgtctgtgagtctatgggaaaaaggagaatactgaaaggcactaagtttactgccacgtttagaggagctttgtcaaggcaacacaagagtgttgtagtcctttgtggccaacaccaacctgagtttttacagcagttgttgcataatgatcacagtcacattcaagttcactttctaaatcttaggttctacaaaaactctgtctgataatgtcctatagacctttcggtagctaaaatcaatgagtttgaaaaataatttgaatttggcttgctcaccttttcagcagaatgcacttgtgagtcctgctctgtcattgtattttacatgtgtggctgtccctcttgctgtgttggaagtcagtgttccagaatgttaacttctacaaatacctatgtatagagcaaagagaaaactcttcaagtcaaaagagtgtatattatttcagggcagctctctagccttggatttgaaactatagtatttgttacacagagagaagatggttcttttttgtattttatttttaatgtttgtgggtacatagtatttatggagtacatgagatgttttgacaagggcattcaatgtgaaaaaaaacacatcctagagaatggggtatcccctcagtgattctttgagttacaaatattccaattacactctttatgttattttcaaatatatgattaagttattattgactatagtcacctgggtttgctatcaaatagtaggtttttattatatattatttcttttttgttttttgtatccattaacaattcctgcctccccctcactctctcactacccttcccaagctctggtaatcatccttctactctctatgtccatgagtttaattgtttttatttttagatcccggaaataagcgagaacacatgatgtttgtatttctgtgcctggcttatttttcttgacataatcatcttcagttccatccatgttgttgcaaatgacaggctttcatttttatggctgaatagtactccactgtgtatatgtaccacattttcttcattcatctgttgatggacacttaggttgctttcaaatattagtaattgtaaacagtgctgcagcaaacctaggagtgcagaaatctctttgatatactcatttcctttcttttgggtatataccaagcagtgggatttttggatcatatggtagtatatctgttttttttcag

SEQ ID NO: 3620 - DNA, 251 bp, Artificial Sequence
  Synthetic oligonucleotide
gaaactccaaactgtccaaggagatagttctgttgtgattacttcattgagaaatttaacttatgagcagttgaaaggaatgcaagttgctgcaaaatcagaatgaagagtgcaaaacgaccaagctacaatgttttgtcattattcactctgatgtgaaaaaggcagtgaatttaatagaaaataacttcgtagagcaaaatctcaggtgtgtttttttagtgccgcagtcttggatgatgggttcctag

SEQ ID NO: 3621 - DNA, 1260 bp, Artificial Sequence
  Synthetic oligonucleotide
aagctctcaacatctcttcttaattggagaaagtgttaagccccaaagtagctggagcagtacatcttcaatttttgacaagaaagcaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatggaagacttttatgtggtttttactcactcttcatctcagacatcaacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactgtattacctaaggctaaacctaaaatttttaagcaaaattagaaaaatagtcttcactcatcaaaaaataaagtttgttacatttagtattttcccaataaaattggtcgttcttggttttttatttggagagtctgtgcaaaatgtcactaaaaataaattagcactagaaattatttctaaataccaaa

SEQ ID NO: 3622 - DNA, 941 bp, Artificial Sequence
  Synthetic oligonucleotide
attattgacatttattttcattctgcctgctgaattttaacttttcctcaaaaagaaaaacttctttctcatgcaaactatccccatatccctaattaggatgaattattgaagcatcctgggtgatttctgaacactttcaatccttcaattattcaggtctagtttaatggcacctgagaacaattacatactgagaactgtcctaaactgacaaaggcgaccaaagagcttatacaggagcatacctgtaccctcacattggctccaaagtctccagagggaaacggacaggacatgatgaatcagctctttttttactgtattatgcttggaaagattgttatggaaacatagaataaatagatagataaatcaaccttgcctggaaaactggaaaaaggttcaaagaggaggcaaatttagaccaatatgtaccaagaactcattgattcttacgggagtaggttattaccagacagacaagtgaaattcagtaggcagaatgataataaatgtcatttattaaatattaaaaagacaaataccttccctattttagaaataaggtaggcaaaggaactgaggagtggaagttgaaggccagctctgggtgctttgtgaacagagcccagttgacagtgggaagatctgtgctctatgctaaggacatgctctgtaatgacaatccactcggttgcactaagaatttaagagcatttatatgaatatatacaatttaaggaaagataaagagaaaaatttgctatcaactctgtgtagatttggaaaatggtgtcaaaggaacagtttcacctgcatttctttgtctagaaagttttattttattaaaaaatgtagtctacaaacgagcctcaatttttggcaataaactcaaaaatgctacacaaaccatcacagaattcggtttgtccttgcag

SEQ ID NO: 3623 - DNA, 388 bp, Artificial Sequence
  Synthetic oligonucleotide
gtaatcacctgcagcacctggacccatctagattaactactcagcctccagaggaaggtcttcaggactcagaccttagttatagattagaagttaatcacttatgtcttcagacaggccctgttccatgtttagagagagatctttgagcacccatcttcatacatttgagaacagggtcactgagagggagtctctgaggtcacagagtttattagttcattttcacactccaggaaagaagtttaattcacagttccacatggctggggaggcctcaggaaacttacaatcatggtggaaggggaagcaaacacatccttcacgtggcagcaggagagagaagtgcagaagaggggaaagtccccttataaaaccatcagatctc

SEQ ID NO: 3624 - DNA, 1953 bp, Artificial Sequence
  Synthetic oligonucleotide
gtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactgggggagatttggcccctctgactactcctaccccatccccactaggacaggagttggtgaaggggacagggtgggaggcttaactagtagccaggggcaggcggcaggcagtggggcgaagatcaggctgaattttcctgctactgatctgctctctggaagaggcattcatgaactggcttaggctgtggcttggctattttaggaatattcttaacccttcctgagtcactgccgccatcagacttctctcccagagcacagagcaccagactattccctctccttgtcccctcctccccagtccctgctttcctccctggcagctgaggtcagagttttctcaggggcggggcaagttgacttctgccaaggaaaactccggggtccctgagcccccttctttgtcctgtgacttctccctcttcatcacagctctggactcagcaaagtggcagaatgggcatcacctcagcccttctcctcatcttataaaattggaacttcagcatctctcatctgagggaaaatagttgacctgcatccccagagtaagatgggaagctgcagtcctgatttccagcctctggcagagcaggagcccctgcctgcctggctttgatgccctgttaggggcacgtttccagcagggagtcacatgccagagcccctcatggggttacctctgcctggttttttcctccactccaggttcttcccagagtctggctttttggaaaaacctaggccatgatataggcattacctctgtaaggctaaggggggtcccactgcgggccaggagggctcaacatcaatatatctgaatttcaagccaagacagggggaaaagatcttggctcagtgtcaggggtttctgtgtccctgacagctgggcttgcctgagctgggaggcccagcatatctgggccttgtgatgccttctgacagtaggagttggagtttgccaccaactgctattgggaaagcttgacatggtgatccaggaataaggctgatgatgccacaaaaatgcccaagggcctgtggtgtgcctgacagtgtcctgggaagtggatatagaggatcaataatcaataatcattatttccctgagaaaggaagctctcttggggtggttaaccaggtgtctggccacaagcctaggccagggttgatgggctggggcaagtgagtcatcccaactcattccccctcctccag

SEQ ID NO: 3625 - DNA, 309 bp, Artificial Sequence
  Synthetic oligonucleotide
gttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggcgtttaaagggtaagaagctgctgggtgtggcagctcacacctgtaattgctgtgctttcag

SEQ ID NO: 3626 - DNA, 176 bp, Artificial Sequence
  Synthetic oligonucleotide
agctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagag

SEQ ID NO: 3627 - DNA, 181 bp, Artificial Sequence
  Synthetic oligonucleotide
gtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatag

SEQ ID NO: 3628 - DNA, 305 bp, Artificial Sequence
  Synthetic oligonucleotide
agtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatg

SEQ ID NO: 3629 - DNA, 324 bp, Artificial Sequence
  Synthetic oligonucleotide
ctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgc

SEQ ID NO: 3630 - DNA, 361 bp, Artificial Sequence
  Synthetic oligonucleotide
ctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgc

SEQ ID NO: 3631 - DNA, 2815 bp, Artificial Sequence
  Synthetic oligonucleotide
ccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcgggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctacgctggagaattgaagggggcggaccccggattaaagccgctcccttcccagcctcgccccgctttcctaatgtccgtgatgatttcgttattggcagggaagagccaggctccctgcgctcccaagacggggcgattgggagggggttctggagctcacgcctggggtcggcccggcgggggtgaccccgcgccctcgccggtgcaaggagaacaggtggttcccgccggggcagggaagcgtggacggtgtgggctcaggcgcctggcaggcacgcggggcctctaaagcttggtcgctgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcgaggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggag

SEQ ID NO: 3632 - DNA, 550 bp, Artificial Sequence
  Synthetic oligonucleotide
gctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaagtgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagaattgcttgaacccgggaggcggaggttgcagtgagcagagatggc

SEQ ID NO: 3633 - DNA, 645 bp, Artificial Sequence
  Synthetic oligonucleotide
cctgggtgacaagagcaactccgtctcccaaaaaataaaaagaagaattgtcaacaagagggagtggcaattcagaagcatatttaagccaagtcctcaagactagaaagcatgaagcaggggaggcgttttgaaagcgtaagaacaatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttagcaggtgctggggaggaccctagggagtggtttatgggggctag

SEQ ID NO: 3634 - DNA, 408 bp, Artificial Sequence
  Synthetic oligonucleotide
ctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttctctctgagattttgcttaagttttggtagatattcttaagttttagtgacctcagtttgggaattaagtaagctaaacattgtgtccttattattagttatataaaactatgctttagactttgttagaaacttctgccccaccttgactgactccttttccatttctggttgtacaaaatgaattcacactttaatgctatggccacctttaaataaagtacagcgtgactaaaaaaaaaa

SEQ ID NO: 3635 - DNA, 107 bp, Artificial Sequence
  Synthetic oligonucleotide
catggcctcacaccactgttacttggtgtacatgagcaaaaacagcaagtggtgaaatttttaatcaagaaaaaagcaaatttaaatgcactggatagatatggaag

SEQ ID NO: 3636 - DNA, 71 bp, Artificial Sequence
  Synthetic oligonucleotide
aatttgccagttactttctgactacaaagaaaaacagatgctaaaagtctcttctgaaaacagcaatccag

SEQ ID NO: 3637 - DNA, 71 bp, Artificial Sequence
  Synthetic oligonucleotide
aacaagacttaaagctgacatcagaggaagagtcacaaaggcttaaaggaagtgaaaatagccagccagag

SEQ ID NO: 3638 - DNA, 45 bp, Artificial Sequence
  Synthetic oligonucleotide
gaaatgtctcaagaaccagaaataaataagggtggtgatagaaag

SEQ ID NO: 3639 - DNA, 49 bp, Artificial Sequence
  Synthetic oligonucleotide
ggacttttctggccatcccaactttcccacgacccttcccatcaaacag

SEQ ID NO: 3640 - DNA, 109 bp, Artificial Sequence
  Synthetic oligonucleotide
tgatgaacaaaatgatactcagaagcaactttctgaagaacagaacactggaatattacaagatgagattctgattcatgaagaaaagcagatagaagtggctgaaaat

SEQ ID NO: 3641 - DNA, 10 bp, Artificial Sequence
  Synthetic oligonucleotide
gaattctgag

SEQ ID NO: 3642 - DNA, 13 bp, Artificial Sequence
  Synthetic oligonucleotide
ctttgtcccagca

SEQ ID NO: 3643 - DNA, 91 bp, Artificial Sequence
  Synthetic oligonucleotide
ctgtgctgtgctggagattcacttttgagagagttctcctctgagacctgatctttagaggctgggcagtcttgcacatgagatggggctg

SEQ ID NO: 3644 - DNA, 15 bp, Artificial Sequence
  Synthetic oligonucleotide
gtctgatctcagcac

SEQ ID NO: 3645 - DNA, 6 bp, Artificial Sequence
  Synthetic oligonucleotide
gttttt

SEQ ID NO: 3646 - DNA, 66 bp, Artificial Sequence
  Synthetic oligonucleotide
gtaaccactgatccacttccagtcactatccatgagtttttatttccaaatacatgaaatcatatg

SEQ ID NO: 3647 - DNA, 95 bp, Artificial Sequence
  Synthetic oligonucleotide
aatttctggtttttcctgttggagcccaaggagcaagggcagaatgaggaacatgatgtttcttaccgacagttactcatgacgtctccatccag

SEQ ID NO: 3648 - DNA, 29 bp, Artificial Sequence
  Synthetic oligonucleotide
gactgaggggggcatccttctccatctag

SEQ ID NO: 3649 - DNA, 9 bp, Artificial Sequence
  Synthetic oligonucleotide
gactggggg

SEQ ID NO: 3650 - DNA, 19 bp, Artificial Sequence
  Synthetic oligonucleotide
catccttctccatccagta

SEQ ID NO: 3651 - DNA, 65 bp, Artificial Sequence
  Synthetic oligonucleotide
gttcatctgtgttgctctaaatgacactgcttcattattttgatggctggagaatatttcctagt

SEQ ID NO: 3652 - DNA, 46 bp, Artificial Sequence
  Synthetic oligonucleotide
gtatgtatatgagagtttcttgatctctttatctgtggatgaacag

SEQ ID NO: 3653 - DNA, 33 bp, Artificial Sequence
  Synthetic oligonucleotide
ctactttgaaacatatggtacatttgtgttaag

SEQ ID NO: 3654 - DNA, 5 bp, Artificial Sequence
  Synthetic oligonucleotide
gctag

SEQ ID NO: 3655 - DNA, 110 bp, Artificial Sequence
  Synthetic oligonucleotide
tcaccctgctgtggaatagaaggccagaattgatcagtctcatctgagagtaactttgtacccatcactgattccttctgagactgcctccacttccccagcagcctctg

SEQ ID NO: 3656 - DNA, 112 bp, Artificial Sequence
  Synthetic oligonucleotide
gtttcttcatgtggctgcagatggcaggatttcccaaaggtttctggctgaaacatattccgtggtgtatctgtacagcagtttcctcatccctgcagctgtgtttgaacag

SEQ ID NO: 3657 - DNA, 24 bp, Artificial Sequence
  Synthetic oligonucleotide
gtcatttaccatgctgtcctccag

SEQ ID NO: 3658 - DNA, 48 bp, Artificial Sequence
  Synthetic oligonucleotide
gttcaacagtatggctccaaaggatgaaatttcattctgattttctgg

SEQ ID NO: 3659 - DNA, 66 bp, Artificial Sequence
  Synthetic oligonucleotide
ctgaagactattctctttgtgtatgtccaccacagttactttatcccttcatctgtggatgggcag

SEQ ID NO: 3660 - DNA, 6 bp, Artificial Sequence
  Synthetic oligonucleotide
atggag

SEQ ID NO: 3661 - DNA, 91 bp, Artificial Sequence
  Synthetic oligonucleotide
gaaagaaaaaagaagaaaacaaacctccatacgagaatgggtctaaaggaacttcccaaacctccatgattttgcaggaaacaagataaag

SEQ ID NO: 3662 - DNA, 119 bp, Artificial Sequence
  Synthetic oligonucleotide
ctccaggccaggagccccaactggctggtggaggatgtcttgctcctcagcagctgggatttgtaagtatttgtaggaacatggaacagatcagtggctgacaggcccaggaagcagac

SEQ ID NO: 3663 - DNA, 10 bp, Artificial Sequence
  Synthetic oligonucleotide
gccactgcac

SEQ ID NO: 3664 - DNA, 5 bp, Artificial Sequence
  Synthetic oligonucleotide
tccag

SEQ ID NO: 3665 - DNA, 19 bp, Artificial Sequence
  Synthetic oligonucleotide
ctggtgaaactgccctttc

SEQ ID NO: 3666 - DNA, 3919 bp, Homo sapiens
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgtgggttatattatattgttcttctgtgcttctttctttttaccctcttttcccctcaagtaatctggcttatttcctccaattgccgtccctttagacttgagacagattctggaaggggaaagctgcaaagtggtttggtggctgggaggggggagtgagtcctagaaggtaatataatgggacatttcagtatgaaaacataacttagttctaacttaagagtggctatagtttgcctgggtgaagaactgggagttaggcagtataccccaattcactgttttgctggttagaattcctgtttaggcctttcttccagaaagtgctggcctggcaaaaaaaattactttgtaagggttctgtgaactctggggaggagccagagctgtctagcatctaacccttaattccctgtttaggaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaactaaaaaat

SEQ ID NO: 3667 - DNA, 2547 bp, Homo sapiens
ttttgtatttttagtagaggcagggtttcgctatgttgcccaggctggtctcaaactcttgacctcaagtgacccacctgcctcggcctcccaaagtgctagcattacaggcgtgagccactgcacctagccttaccacccattttttatatatgttgtgtgttctagtgctttggttcattcctaacttggaggaagatcttaagtaaggttagagtaaggatatagatgatgaacttattcaatgcaggagttgctctcatcctttgagaccataagaattttcttagttgagtcttcaagtagctattgcttcttatttatgtgctttcttcttacttcattttgtgtacctctttatatgttaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaactaaaaaat

SEQ ID NO: 3668 - DNA, 3674 bp, Homo sapiens
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaactaaaaaat

SEQ ID NO: 3669 - DNA, 3750 bp, Homo sapiens
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctcttttgactctggatcccccaagcaaagcatttggctggctattgcaaggctggttaataggatcttttatctattgaagacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaactaaaaaat

SEQ ID NO: 3670 - DNA, 2133 bp, Homo sapiens
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtaagttaccacttttcctttatcaacctcaaaggtgttgaacttgacattgactgacctcagtttcactgttactaagcagttgtcagtgctagatttaaagcccaactttttctaacttttttttggagctactttacctggtaaacaatgtagtctccatattataaagccatctatcttcaagatagtgatagccctgattgaccacagcatggatattgagagtaatattgaactgctttcttagggcttgcaaaatcaaggtgctagagatacctaagattatagaatagtggaataagatttggaaccagagaattgggcttgaatctcaggcctgccacacattggttttgtgaccttggataggtaacttagcttttgagcctcagtttccttttttattgtaacatatatacttcacaaggatgtgatgagaatttaatgaggtagaaagtataaagcagggaaataaaaaaagctccatagaataccatacaaaccttattggtatttgaatggtgttgaacttgggtggtttacaatatgctgaacttcagcagaagcgacagatttattcataccagtttttcgtttcttggtgattaattttcctctgaggaaaaattaccaccctttgttgttgttgttgttgttttttttgagacagagccttgctctgtcgcccaagctggagtgtggtggcacaatcttggctcactgcaatctccacctcctgcgttcaagcagttctcctgcctcagcctcctgaatagctgggattacagcacccaccaccacgcctagctaat

SEQ ID NO: 3671 - DNA, 1914 bp, Homo sapiens
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtaagttaccacttttcctttatcaacctcaaaggtgttgaacttgacattgactgacctcagtttcactgttactaagcagttgtcagtgctagatttaaagcccaactttttctaacttttttttggagctactttacctggtaaacaatgtagtctccatattataaagccatctatcttcaagatagtgatagccctgattgaccacagcatggatattgagagtaatattgaactgctttcttagggcttgcaaaatcaaggtgctagagatacctaagattatagaatagtggaataagatttggaaccagagaattgggcttgaatctcaggcctgccacacattggttttgtgaccttggataggtaacttagcttttgagcctcagtttccttttttattgtaacatatatacttcacaaggatgtgatgagaatttaatgaggtagaaagtataaagcagggaaataaaaaaagctccatagaataccatacaaaccttattggtatttgaatggtgttgaacttgggtggtttacaatatgctgaacttcagcagaagcgacagatttattcataccagtttttcgtttcttggtgattaattttcctctgaggaaaaattaccaccctttgttgttgttgttgttgttttttttgagacagagccttgctctgtcgcccaagctggagtgtggtggcacaatcttggctcactgcaatctccacctcctgcgttcaagcagttctcctgcctcagcctcctgaatagctgggattacagcacccaccaccacgcctagctaat

SEQ ID NO: 3672 - DNA, 331 bp, Artificial Sequence
  Synthetic oligonucleotide
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggca

SEQ ID NO: 3673 - DNA, 123 bp, Artificial Sequence
  Synthetic oligonucleotide
acggaaacgaggtgaaaagggagaagtggtggaaactgttgaagatgttattgttcggaaattgactgctgagcgagttgaagaactaaagaaagtgataaaggaaacccaggagagatatag

SEQ ID NO: 3674 - DNA, 422 bp, Artificial Sequence
  Synthetic oligonucleotide
gtgggttatattatattgttcttctgtgcttctttctttttaccctcttttcccctcaagtaatctggcttatttcctccaattgccgtccctttagacttgagacagattctggaaggggaaagctgcaaagtggtttggtggctgggaggggggagtgagtcctagaaggtaatataatgggacatttcagtatgaaaacataacttagttctaacttaagagtggctatagtttgcctgggtgaagaactgggagttaggcagtataccccaattcactgttttgctggttagaattcctgtttaggcctttcttccagaaagtgctggcctggcaaaaaaaattactttgtaagggttctgtgaactctggggaggagccagagctgtctagcatctaacccttaattccctgtttag

SEQ ID NO: 3675 - DNA, 137 bp, Artificial Sequence
  Synthetic oligonucleotide
ctcgtcaagcagtaaaaacacccccccggaggttacccactgtgatggttcgctctcctatagattctgcctccccaggaggtgattatccacttggggacttgactccaaccactatggaagaggctacctctggg

SEQ ID NO: 3676 - DNA, 219 bp, Artificial Sequence
  Synthetic oligonucleotide
gtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactg

SEQ ID NO: 3677 - DNA, 145 bp, Artificial Sequence
  Synthetic oligonucleotide
gtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcag

SEQ ID NO: 3678 - DNA, 815 bp, Artificial Sequence
  Synthetic oligonucleotide
gtaagttaccacttttcctttatcaacctcaaaggtgttgaacttgacattgactgacctcagtttcactgttactaagcagttgtcagtgctagatttaaagcccaactttttctaacttttttttggagctactttacctggtaaacaatgtagtctccatattataaagccatctatcttcaagatagtgatagccctgattgaccacagcatggatattgagagtaatattgaactgctttcttagggcttgcaaaatcaaggtgctagagatacctaagattatagaatagtggaataagatttggaaccagagaattgggcttgaatctcaggcctgccacacattggttttgtgaccttggataggtaacttagcttttgagcctcagtttccttttttattgtaacatatatacttcacaaggatgtgatgagaatttaatgaggtagaaagtataaagcagggaaataaaaaaagctccatagaataccatacaaaccttattggtatttgaatggtgttgaacttgggtggtttacaatatgctgaacttcagcagaagcgacagatttattcataccagtttttcgtttcttggtgattaattttcctctgaggaaaaattaccaccctttgttgttgttgttgttgttttttttgagacagagccttgctctgtcgcccaagctggagtgtggtggcacaatcttggctcactgcaatctccacctcctgcgttcaagcagttctcctgcctcagcctcctgaatagctgggattacagcacccaccaccacgcctagctaat

SEQ ID NO: 3679 - DNA, 246 bp, Artificial Sequence
  Synthetic oligonucleotide
ttttgtatttttagtagaggcagggtttcgctatgttgcccaggctggtctcaaactcttgacctcaagtgacccacctgcctcggcctcccaaagtgctagcattacaggcgtgagccactgcacctagccttaccacccattttttatatatgttgtgtgttctagtgctttggttcattcctaacttggaggaagatcttaagtaaggttagagtaaggatatagatgatgaacttattcaat

SEQ ID NO: 3680 - DNA, 122 bp, Artificial Sequence
  Synthetic oligonucleotide
gcaggagttgctctcatcctttgagaccataagaattttcttagttgagtcttcaagtagctattgcttcttatttatgtgctttcttcttacttcattttgtgtacctctttatatgttag

SEQ ID NO: 3681 - DNA, 281 bp, Artificial Sequence
  Synthetic oligonucleotide
tgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaag

SEQ ID NO: 3682 - DNA, 215 bp, Artificial Sequence
  Synthetic oligonucleotide
gatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagtt

SEQ ID NO: 3683 - DNA, 178 bp, Artificial Sequence
  Synthetic oligonucleotide
gcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccag

SEQ ID NO: 3684 - DNA, 177 bp, Artificial Sequence
  Synthetic oligonucleotide
acagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacag

SEQ ID NO: 3685 - DNA, 173 bp, Artificial Sequence
  Synthetic oligonucleotide
gatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctggg

SEQ ID NO: 3686 - DNA, 180 bp, Artificial Sequence
  Synthetic oligonucleotide
ttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaactaaaaaat

SEQ ID NO: 3687 - DNA, 97 bp, Artificial Sequence
  Synthetic oligonucleotide
aacacaagctgctaagcactggccccacagagccatggtccatccgagagaagctatgtttagcatcttctgtcatgagaagtggcgatcaaaattg

SEQ ID NO: 3688 - DNA, 70 bp, Artificial Sequence
  Synthetic oligonucleotide
ggtatcagttagcagagcaatcaagccctttgcagaacctggccgccctccagactggttctctcaaaaa

SEQ ID NO: 3689 - DNA, 50 bp, Artificial Sequence
  Synthetic oligonucleotide
cattgtgcttcccagtactcggagcttttagagaccactgagacaccaaa

SEQ ID NO: 3690 - DNA, 76 bp, Artificial Sequence
  Synthetic oligonucleotide
acggctaaagagagatgcagaactaattcaagctggacacatggacagcagactggatgagctttgcaatgacatt

SEQ ID NO: 3691 - DNA, 5 bp, Artificial Sequence
  Synthetic oligonucleotide
gcaac

SEQ ID NO: 3692 - DNA, 57 bp, Artificial Sequence
  Synthetic oligonucleotide
gaaaaagaaattggaagaagaggaggctgaagtaaagaggaaggctacagatgctgc

SEQ ID NO: 3693 - DNA, 8 bp, Artificial Sequence
  Synthetic oligonucleotide
ataccagg

SEQ ID NO: 3694 - DNA, 117 bp, Artificial Sequence
  Synthetic oligonucleotide
gtgctcccactctttcccggcttttagaagctggtcctacacagttcaccacacctcttgcttccttcactactgttgccagtgagcctccagttaaacttgtgccaccccctgtag

SEQ ID NO: 3695 - DNA, 93 bp, Artificial Sequence
  Synthetic oligonucleotide
agtctgtgtcccaagctaccattgtcatgatgcctgcgctgccagcaccatcctctgctccggctgtctccactactgaaagtgtagctccag

SEQ ID NO: 3696 - DNA, 114 bp, Artificial Sequence
  Synthetic oligonucleotide
gtagatgatcatcctgaagtgctggatgtggcagcagtggaagcagcactgtcattttgtgaagaaaatgatgatcctcagtccctgcctggcccctgggagcatcctatccag

SEQ ID NO: 3697 - DNA, 37 bp, Artificial Sequence
  Synthetic oligonucleotide
caggagcgggacaagccagtacctctccctgcaccag

SEQ ID NO: 3698 - DNA, 8 bp, Artificial Sequence
  Synthetic oligonucleotide
aaatgacg

SEQ ID NO: 3699 - DNA, 42 bp, Artificial Sequence
  Synthetic oligonucleotide
gtcaagcaagagagactggactttgaggaaacggaaaacaag

SEQ ID NO: 3700 - DNA, 73 bp, Artificial Sequence
  Synthetic oligonucleotide
ggaatacatgaactggtggacatcagggagcccagtgcagagatcaaggtggaacctgcagaaccagagccag

SEQ ID NO: 3701 - DNA, 111 bp, Artificial Sequence
  Synthetic oligonucleotide
tcatttcaggagccgaaatagtagctggagttgttccagccacaagtatggagccaccagaactcaggagtcaggacttagatgaggaactgggaagtactgcagctggag

SEQ ID NO: 3702 - DNA, 68 bp, Artificial Sequence
  Synthetic oligonucleotide
agattgttgaagcagatgttgccattgggaaaggcgatgagactccacttacaaatgtgaagacagag

SEQ ID NO: 3703 - DNA, 94 bp, Artificial Sequence
  Synthetic oligonucleotide
gcatcccctgaaagcatgttgtctccatcacatggctcaaatcccattgaagatcctttagaggcagagactcagcacaagtttgaaatgtcag

SEQ ID NO: 3704 - DNA, 47 bp, Artificial Sequence
  Synthetic oligonucleotide
actcattgaaagaagaatcagggactatttttggaagccagataaag

SEQ ID NO: 3705 - DNA, 93 bp, Artificial Sequence
  Synthetic oligonucleotide
ctctgtctgtagtgaggatcaggaagctattcaggcacagaaaatttggaagaaagccatcatgcttgtatggagagctgcagctaatcatag

SEQ ID NO: 3706 - DNA, 69 bp, Artificial Sequence
  Synthetic oligonucleotide
gtatgccaatgtcttcctgcagcctgttacagatgacatagcacctggctaccacagcattgtgcagag

SEQ ID NO: 3707 - DNA, 105 bp, Artificial Sequence
  Synthetic oligonucleotide
caattcttggccacgcagttgattatgcaaacatccgagtctgggatcagtgctaaaagtcttcgagggagagattctacccgcaaacaggatgcttcagagaag

SEQ ID NO: 3708 - DNA, 45 bp, Artificial Sequence
  Synthetic oligonucleotide
gacagtgtcccaatgggctctcctgccttccttctctctctcttt

SEQ ID NO: 3709 - DNA, 76 bp, Artificial Sequence
  Synthetic oligonucleotide
tgactctggatcccccaagcaaagcatttggctggctattgcaaggctggttaataggatcttttatctattgaag

SEQ ID NO: 3710 - DNA, 36 bp, Artificial Sequence
  Synthetic oligonucleotide
ccacacgacatgagctggaaaatctctcttagagag

SEQ ID NO: 3711 - DNA, 8315 bp, Homo sapiens
tccttcggccccggcggggctctggcgtacccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctacgagagagaattgagagacaagtgaaaggggtttccccttataaaaaaaccatcagatcttatgagacttattcactaccacaagaacagtatgagagaactgcccccatgattcaattatctcccaccgggtccctcccaaaacacgtggaaattatgggagttacaattcaaaggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggttttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 3712 - DNA, 3868 bp, Homo sapiens
tccttcggccccggcggggctctggcgtacccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttggatatgctttggaacaacagacctggattcaaaaactacctttctatattgggattcttgtttccaggtctggtgaagttcaagggcatcttgaacgtggtgcacttggagacagtgagggaagcaggggtgaagtggctgctacctgagtcccttctggaggctccattttgcttggtcttggagaaggcttctcagctgccctcccagctagtgtaagcactgcaattgtacctgttacctgagtcaacagatccagatgagaggtgtaggcaggagggtcatctctgtgcatttaggaaaagcagcactgatgctagtagagcatccagttccccaacatgatcacccctgaagccttaattcccaaatccttccaagccttatctgtaggggcttaatgaggacagagaggaagaaacagtcactctggcacaacaggacaatatattcagattaaatctgaaaatggtggaggcctgctgcccatgaattctgagcctctccaaccctggtcccataatgaaactagtagtagggtcttccaaatggcattagacaagggttccatctgtgtaaggaccactgggagttagactggacccaggatggtatgccatgtgcagccatgtcaacccccaatttgctcctctccttccttagctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgcttccaagatagccaaataggaacagctctggtctgcagctcccagcaagatcgatgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgctcactgctagcgcaacagtctaagatcgacctgcgacgctgcagcttgatgcagggagaggcatccaacattgctgaggcttgagtagctcacagtgtaagcaaagaggcccggaagcacaagttgggcagagctcatcgctgctcagcagggcctactgcctctatagattccacctctggaggcagggcatggcagaaaaaaacgcagcagacagcttttgcagacttaaacgtccctgtctgatggctctaaagagagcaatggttctctcagcatggcattcgagctccaagaacagacagactgcctccccaagcaggtccctgacccccatgtagctggactgggaaacacctccccatcaggggctgagagatacctcaaacacgtgggtgcccctctgggacgaagcttccagaggaaggatcaggcagcaatatttgctattctgcagcctttgctggtgatacccaggcaaacagattctggagtggacctccagcaaactccaacaaacctg

SEQ ID NO: 3713 - DNA, 4044 bp, Homo sapiens
tccttcggccccggcggggctctggcgtacccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctacgagagagaattgagagacaagtgaaaggggtttccccttataaaaaaaccatcagatcttatgagacttattcactaccacaagaacagtatgagagaactgcccccatgattcaattatctcccaccgggtccctcccaaaacacgtggaaattatgggagttacaattcaaaggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttggatatgctttggaacaacagacctggattcaaaaactacctttctatattgggattcttgtttccaggtctggtgaagttcaagggcatcttgaacgtggtgcacttggagacagtgagggaagcaggggtgaagtggctgctacctgagtcccttctggaggctccattttgcttggtcttggagaaggcttctcagctgccctcccagctagtgtaagcactgcaattgtacctgttacctgagtcaacagatccagatgagaggtgtaggcaggagggtcatctctgtgcatttaggaaaagcagcactgatgctagtagagcatccagttccccaacatgatcacccctgaagccttaattcccaaatccttccaagccttatctgtaggggcttaatgaggacagagaggaagaaacagtcactctggcacaacaggacaatatattcagattaaatctgaaaatggtggaggcctgctgcccatgaattctgagcctctccaaccctggtcccataatgaaactagtagtagggtcttccaaatggcattagacaagggttccatctgtgtaaggaccactgggagttagactggacccaggatggtatgccatgtgcagccatgtcaacccccaatttgctcctctccttccttagctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgcttccaagatagccaaataggaacagctctggtctgcagctcccagcaagatcgatgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgctcactgctagcgcaacagtctaagatcgacctgcgacgctgcagcttgatgcagggagaggcatccaacattgctgaggcttgagtagctcacagtgtaagcaaagaggcccggaagcacaagttgggcagagctcatcgctgctcagcagggcctactgcctctatagattccacctctggaggcagggcatggcagaaaaaaacgcagcagacagcttttgcagacttaaacgtccctgtctgatggctctaaagagagcaatggttctctcagcatggcattcgagctccaagaacagacagactgcctccccaagcaggtccctgacccccatgtagctggactgggaaacacctccccatcaggggctgagagatacctcaaacacgtgggtgcccctctgggacgaagcttccagaggaaggatcaggcagcaatatttgctattctgcagcctttgctggtgatacccaggcaaacagattctggagtggacctccagcaaactccaacaaacctg

SEQ ID NO: 3714 - DNA, 296 bp, Artificial Sequence
  Synthetic oligonucleotide
tccttcggccccggcggggctctggcgtacccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccag

SEQ ID NO: 3715 - DNA, 266 bp, Artificial Sequence
  Synthetic oligonucleotide
ccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgat

SEQ ID NO: 3716 - DNA, 215 bp, Artificial Sequence
  Synthetic oligonucleotide
gggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatag

SEQ ID NO: 3717 - DNA, 176 bp, Artificial Sequence
  Synthetic oligonucleotide
acgagagagaattgagagacaagtgaaaggggtttccccttataaaaaaaccatcagatcttatgagacttattcactaccacaagaacagtatgagagaactgcccccatgattcaattatctcccaccgggtccctcccaaaacacgtggaaattatgggagttacaattcaaa

SEQ ID NO: 3718 - DNA, 142 bp, Artificial Sequence
  Synthetic oligonucleotide
gttcgttcatctttatttgaactggctaagaaaacaaagtttaatttatgtcgtcataccgtggttacctgcatactcttggttgttatcaacttgttggtgatcttcataccctccatgaaggatatttttggagtcgtag

SEQ ID NO: 3719 - DNA, 1736 bp, Artificial Sequence
  Synthetic oligonucleotide
atatgctttggaacaacagacctggattcaaaaactacctttctatattgggattcttgtttccaggtctggtgaagttcaagggcatcttgaacgtggtgcacttggagacagtgagggaagcaggggtgaagtggctgctacctgagtcccttctggaggctccattttgcttggtcttggagaaggcttctcagctgccctcccagctagtgtaagcactgcaattgtacctgttacctgagtcaacagatccagatgagaggtgtaggcaggagggtcatctctgtgcatttaggaaaagcagcactgatgctagtagagcatccagttccccaacatgatcacccctgaagccttaattcccaaatccttccaagccttatctgtaggggcttaatgaggacagagaggaagaaacagtcactctggcacaacaggacaatatattcagattaaatctgaaaatggtggaggcctgctgcccatgaattctgagcctctccaaccctggtcccataatgaaactagtagtagggtcttccaaatggcattagacaagggttccatctgtgtaaggaccactgggagttagactggacccaggatggtatgccatgtgcagccatgtcaacccccaatttgctcctctccttccttagctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgcttccaagatagccaaataggaacagctctggtctgcagctcccagcaagatcgatgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgctcactgctagcgcaacagtctaagatcgacctgcgacgctgcagcttgatgcagggagaggcatccaacattgctgaggcttgagtagctcacagtgtaagcaaagaggcccggaagcacaagttgggcagagctcatcgctgctcagcagggcctactgcctctatagattccacctctggaggcagggcatggcagaaaaaaacgcagcagacagcttttgcagacttaaacgtccctgtctgatggctctaaagagagcaatggttctctcagcatggcattcgagctccaagaacagacagactgcctccccaagcaggtccctgacccccatgtagctggactgggaaacacctccccatcaggggctgagagatacctcaaacacgtgggtgcccctctgggacgaagcttccagaggaaggatcaggcagcaatatttgctattctgcagcctttgctggtgatacccaggcaaacagattctggagtggacctccagcaaactccaacaaacctg

SEQ ID NO: 3720 - DNA, 3728 bp, Artificial Sequence
  Synthetic oligonucleotide
gctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagca

SEQ ID NO: 3721 - DNA, 176 bp, Artificial Sequence
  Synthetic oligonucleotide
accagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctcc

SEQ ID NO: 3722 - DNA, 1526 bp, Artificial Sequence
  Synthetic oligonucleotide
ctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggttttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaa

SEQ ID NO: 3723 - DNA, 351 bp, Artificial Sequence
  Synthetic oligonucleotide
tttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 3724 - DNA, 115 bp, Artificial Sequence
  Synthetic oligonucleotide
atatttattgagtgtctactgtgtgccaggcactatatctatgtgcatagaaaaaccctggaaggccatacaacaatatatatagagtgatcgtctctgcttgctgagctaacag

SEQ ID NO: 3725 - DNA, 76 bp, Artificial Sequence
  Synthetic oligonucleotide
caagtttatttctgatcgtgaaagtagaagaagtctcacaaacagccatttggaaaaaaagaagtgtgatgagtat

SEQ ID NO: 3726 - DNA, 116 bp, Artificial Sequence
  Synthetic oligonucleotide
attccaggtacaacctccttaggcatgtctgtttttaacctaagcaacgccattatgggcagtgggattttgggactcgcctttgccctggcaaacactggaatcctactttttct

SEQ ID NO: 3727 - DNA, 74 bp, Artificial Sequence
  Synthetic oligonucleotide
ggtacttttgacttcagtgacattgctgtctatatattcaataaacctcctattgatctgttcaaaagaaacag

SEQ ID NO: 3728 - DNA, 93 bp, Artificial Sequence
  Synthetic oligonucleotide
gctgcatggtgtatgaaaagctgggggaacaagtctttggcaccacagggaagttcgtaatctttggagccacctctctacagaacactggag

SEQ ID NO: 3729 - DNA, 82 bp, Artificial Sequence
  Synthetic oligonucleotide
caatgctgagctacctcttcatcgtaaaaaatgaactaccctctgccataaagtttctaatgggaaaggaagagacattttc

SEQ ID NO: 3730 - DNA, 83 bp, Artificial Sequence
  Synthetic oligonucleotide
agcctggtacgtggatggccgcgttctggtggtgatagttacctttggcataattctccctctgtgtctcttgaagaacttag

SEQ ID NO: 3731 - DNA, 59 bp, Artificial Sequence
  Synthetic oligonucleotide
ggtatcttggctatactagtggattttccttgagctgtatggtttttttcctaattgtg

SEQ ID NO: 3732 - DNA, 117 bp, Artificial Sequence
  Synthetic oligonucleotide
gttatttacaagaaatttcaaattccctgcattgttccagagctaaattcaacaataagtgctaattcaacaaatgctgacacgtgtacgccaaaatatgttaccttcaattcaaag

SEQ ID NO: 3733 - DNA, 80 bp, Artificial Sequence
  Synthetic oligonucleotide
accgtgtatgctttacccaccattgcatttgcatttgtttgccacccgtcagtcctgccaatttacagtgagcttaaaga

SEQ ID NO: 3734 - DNA, 101 bp, Artificial Sequence
  Synthetic oligonucleotide
ccgatcacagaaaaaaatgcagatggtttcaaacatctcctttttcgccatgtttgttatgtacttcttgactgccatttttggctacttgacattctatg

SEQ ID NO: 3735 - DNA, 119 bp, Artificial Sequence
  Synthetic oligonucleotide
acaacgtgcagtccgacctccttcacaaatatcagagtaaagatgacattctcatcctgacagtgcggctggctgtcattgttgctgtgatcctcacagtgccggtgttatttttcacg

SEQ ID NO: 3736 - DNA, 98 bp, Artificial Sequence
  Synthetic oligonucleotide
gagttacatctgctaacatgcttattttcattcttccttcatctctttatttaaaaatcacagaccaggatggagataaaggaactcaaagaatttgg

SEQ ID NO: 3737 - DNA, 85 bp, Artificial Sequence
  Synthetic oligonucleotide
cctaagactattaccctggaactgactgctttctagagcttgattcatgcctctaagccagtggttctcaaagtgtggcccctag

SEQ ID NO: 3738 - DNA, 86 bp, Artificial Sequence
  Synthetic oligonucleotide
ctcaccagatgattcctaggactcatggtgcaacatacaggagccaggctttagggaggggaggaaaggagcctggcggcaggggt

SEQ ID NO: 3739 - DNA, 55 bp, Artificial Sequence
  Synthetic oligonucleotide
aacaaagaaccattatctaatcaagctttgaaagtcctgcatgtttgccttttat
